United States Patent 7,745,391 (HUMAN THROMBOSPONDIN POLYPEPTIDE) - sequence listing, part 29

SEQ ID NO: 67692 - DNA, 2793 bp, Homo sapiens
aggcgtacgctcggttcgggatgcgccagggtaggggctgcgcttggggtttgctgaagctggctgcctctcccactccccttttgggtgcaaagcgccgctagcgggaagacgggggccgggcggggacaggggcacctgcgtagctggactgagagcctgcgcccagcttacatcgaccccacccggccccggcccgacccgacgcgacccgatccgatccgatcccattccatccgttcctcgtctcctcccggtctgacccgttgcccggccgtggttcgccacaccaggcatccaaagctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtaccccctgggttggagactgctcattttcctcccaaattaatcccagaccccctaaaatattgacaaccttgacaaccccccaaccgaggagccagactttgttttggactaacttccatagccctgtcatggaggcagtgtacctggtagtgaatgggttgggcctggtgctggacgtgctgaccttggtgttggacctcaacttcctgctggtgtcctccctcctggcttccctggcctggctcctggccttcgtctacaacctgccgcacacggtactgactagtcttctgcacttgggccgcggagtcttgctttcattgctggccttgatcgaagccgtggtccggttcacatgtgggggcttgcaggccttgtgtactctgctgtatagctgctgctctggcctagagagcctaaagctcctggggcacctggcctctcatggggcactgcggagcagggagatactgcaccggggcgtcctcaatgtggtctccagtggccatgctttgctgcgccaggcctgtgacatctgtgccattgccatgagcctggtggcttatgtgatcaacagcctggtcaacatctgcctcatcggcactcagaacctcttttccctggtgctggccctgtgggatgcagtgaccgggcctctgtggaggatgacagacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctcatgca

SEQ ID NO: 67693 - DNA, 2564 bp, Homo sapiens
atagctaggtagagccggggttaatcggcagaggccgttgcccggccgtggttcgccacaccaggcatccaaagctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtaccccctgggttggagactgctcattttcctcccaaattaatcccagaccccctaaaatattgacaaccttgacaaccccccaaccgaggagccagactttgttttggactaacttccatagccctgtcatggaggcagtgtacctggtagtgaatgggttgggcctggtgctggacgtgctgaccttggtgttggacctcaacttcctgctggtgtcctccctcctggcttccctggcctggctcctggccttcgtctacaacctgccgcacacggtactgactagtcttctgcacttgggccgcggagtcttgctttcattgctggccttgatcgaagccgtggtccggttcacatgtgggggcttgcaggccttgtgtactctgctgtatagctgctgctctggcctagagagcctaaagctcctggggcacctggcctctcatggggcactgcggagcagggagatactgcaccggggcgtcctcaatgtggtctccagtggccatgctttgctgcgccaggcctgtgacatctgtgccattgccatgagcctggtggcttatgtgatcaacagcctggtcaacatctgcctcatcggcactcagaacctcttttccctggtgctggccctgtgggatgcagtgaccgggcctctgtggaggatgacagacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctcatgca

SEQ ID NO: 67694 - DNA, 2815 bp, Homo sapiens
tttgcggacacaagatggcggcgcccagcggagtaggggctgcgcttggggtttgctgaagctggctgcctctcccactccccttttgggtgcaaagcgccgctagcgggaagacgggggccgggcggggacaggggcacctgcgtagctggactgagagcctgcgcccagcttacatcgaccccacccggccccggcccgacccgacgcgacccgatccgatccgatcccattccatccgttcctcgtctcctcccggtctgacccgttgcccggccgtggttcgccacaccaggcatccaaagctgaggtcgctcctacggcctgggctcgccttcgctttagagatgtttggcctcttccctcccaaacagcccatcttcaaaacctggactcttggactggcacctggccacctttccctctaccaagactccacttccgtcttacccacttcttcctcagattcttggtaccccctgggttggagactgctcattttcctcccaaattaatcccagaccccctaaaatattgacaaccttgacaaccccccaaccgaggagccagactttgttttggactaacttccatagccctgtcatggaggcagtgtacctggtagtgaatgggttgggcctggtgctggacgtgctgaccttggtgttggacctcaacttcctgctggtgtcctccctcctggcttccctggcctggctcctggccttcgtctacaacctgccgcacacggtactgactagtcttctgcacttgggccgcggagtcttgctttcattgctggccttgatcgaagccgtggtccggttcacatgtgggggcttgcaggccttgtgtactctgctgtatagctgctgctctggcctagagagcctaaagctcctggggcacctggcctctcatggggcactgcggagcagggagatactgcaccggggcgtcctcaatgtggtctccagtggccatgctttgctgcgccaggcctgtgacatctgtgccattgccatgagcctggtggcttatgtgatcaacagcctggtcaacatctgcctcatcggcactcagaacctcttttccctggtgctggccctgtgggatgcagtgaccgggcctctgtggaggatgacagacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctcatgcaaaaaaaaagacaaggggtcg

SEQ ID NO: 67695 - DNA, 1786 bp, Homo sapiens
tatctatgttagccgttgttaatcaggcacgagggatcaccagcctggtcaacatctgcctcatcggcactcagaacctcttttccctggtgctggccctgtgggatgcagtgaccgggcctctgtggaggatgacagacgtagtggctgccttcctagcccacatttccagcagtgctgtggccatggccatcctcctttggacaccctgccaactagccctggagctgctggcctcagctgcccgcctcctggccagctttgtgcttgtcaatctcactggcttggtgttgctagcttgtgtgctggcagtgacggtgactgtgttgcatccggacttcaccctgaggctggctacccaggcactcagccagctccatgcccggccatcctaccaccgtcttcgagaggatgtcatgcggctctctcgcctagcactgggctcagaggcctggcgccgagtctggagccgcagtctgcagctggcgagttggccaaaccggggaggggcacctggagctccccagggtgaccctatgagggtattctcagttaggacccggagacaggacactcttcctgaagcggggcgcagatcagaggcagaagaggaggaggccaggaccatcagagtgacacctgtcaggggccgagagaggctcaatgaggaggagcctccaggtgggcaagacccttggaaattgctgaaggagcaagaggagcggaagaagtgtgtcatctgccaggaccagagcaagacagtgttgctcctgccctgccggcatctgtgcctgtgccaggcctgcactgaaatcctgatgcgccaccccgtctaccaccgcaattgcccgctctgccgccggggcatcctgcagaccctcaatgtctacctctgaagcctccttccctgcctgcccacccctccatgctccacgcaggcactcacgctaggacagcattaacacctcatctccgggtcctggtctgaatcccctcctacccctgtggccatcctgccatacatccaggacattgagttggaagactatgatctgggtgggggcaggataacatggcttctctttacccagtgggtcccttcgatgctgagggtggtgagtatgtcactatgcaagggccctgagactatttgctgtgggctctcctccagcctgcccagggcccacccagatgcctctggggttacccctgtctgcttctggtttttctgttggagatctataggtccttttcctgcctccttcacatttcctccccagcttttgcggccacaacacatcagtgtcatttgggtgttttggcaactcaggggccttcggatgatcttaaacctttgtgttcagccagagcccctgtgccctggtaggcgttggggttagtatctctcgggtgccctcagagccacctctgcctgtgatcgtctgatgaggctccctcccaacctgatccaaaagccagtctcaggagtttacccctgggatgggggatgcatctgcacctgactttggggccacgtgccctgtggcaccccagctcactgggagtctcaggagggataaccggatttctgctctttcccctgtcactcccacatcacacagaaaaatggcattcctctctgtctctccctggcatggagagggcagactgtgcacatttcactagggtccaaatacagaagggcccagggcccaggggcttgcagcttcgtgaggggtctctggcccagtttccaatgaataaagttctcttgacagctcatgca

SEQ ID NO: 67696 - DNA, 503 bp, Homo sapiens
atggcccttcctccccatcatccaccatggggccctcctgtgccacaacatggctctcatccttctgtctggacacttgccctgcctcctggagagccaggctcctgccctggcgggcatgtgagtgtgcatgtgtgtgagttgtgcatgtgtgtgcatgtggcacggagggggaagaagagagttctcctctgtggtgatcgccaccattcagttgaagggtttaagctgagccaagatgaagcaagagtgacaccaagtgccaagaacaagtgcttgctgtggtatcaggtgtgctctctcctcaaatcagaggagcagagagaagctcagttccagtctgcagtgttcacccctgtgagagggtgccgacccatccagaggtggccagccccctccagaggtggctcagtgctggcatgccactctgcccatttggacaaggggatggcctctctgggaattggatgcggaaccgaagctttgaatagatttaaaaaata

SEQ ID NO: 67697 - DNA, 463 bp, Homo sapiens
ctgctggtgtggggcaggagaagccataaggcactaaaaataacagcacacctcacatctatctggatggctgttatcaaaagaacagaaagtaatgctggtgagaatgtggggaaactggagcccttgtgcattgctggtggaaatgtaaaacgatgcagctactatagaaaatggttgagggtcctcaaaaaattaaacgcagagttaccatataatccagcaattccacttctaggtgtatacccccccaatgttgaaagccgggactcaaaaagacatgtgtacacacatgttcatagcatcggtattcacacactctattggttctgtttctccagtgaatcctgactaatgcatcttccaaaagaatctacagaacagctggggagcatgagtctaaggtctgtaggctccagatgaaagatcctgtcgctgatgctgggccagcctacaagcaccc

SEQ ID NO: 67698 - DNA, 433 bp, Homo sapiens
gatttataatgtctaattgcttgtccattttctgctgggagtataatttgaggagggttgagttccaattttccaatttttattatcaaaagtattacttcatcgtaaaagtaactttcctgttaacccagtattgtaccaaatggcagtataatttaaatcaaatgttgtctggttgcaagtaagatctaaaacagctacagtctcatttttcctccctttctaatgtaagcaaccttttcctattgtgttagtccattttcatgctgctgataaagacatacctgagactgggcaatttacaaaagaatgaggtttaattggacttacagttccacgtgctggggaagcctcacaatcatggcagaaagcaaggaggaacaagtctcgttttacgtggatggcagcagacaaagagagaatgaggaagaca

SEQ ID NO: 67699 - DNA, 288 bp, Homo sapiens
tgagacagggtcttgctctgtcacctggagtacagtggtgtgatcatggctcactgcagccccaaccaatcctctggcctcagcctccaaagtagctgagactacacgtgcatgccagcatgcttggcaattttttttttttttttttgagacggagtctcactctgtcgcccaggctggagtgcagtggtgcgatctccgctcactgcaagctccgcctcctgggttcatgccattctcctgcctcagcctcccgagtagctgggactacaggtgcctgccaccacg

SEQ ID NO: 67700 - DNA, 797 bp, Homo sapiens
cccagctgacatgatacttcttgatatcaaaatattttacagagctacaataaccaaaacagtatgggactagcttaaagagacatacagaccaaaggagcagaatagagagcccacaaataaaaacatgcaaataatatggtcaactgatcttcagggatgccaagaatgcacaataaggaaggaatgttttctgcaacaaatgatgttggaagaactaggtattcacatgaaaaaagatgaaattggacccctatcttctaccataaaaaagaaaaaaactcacaatgaattggagacttagacataagaccaaaaaatgtaaatctcctggaagaaaacatgaggggaagcttcaccacatcattcttagtaatttcgtggatgtgacgtcaaaagcacagccaacaacagaaaataagacaggtgggactacatcaaactaaaaagcttctgtacagcaaaggaaacaactgagtgaaaaggaaatctaaggaatgggagaaagtatttgcagaaccaaataaatgataaggaatgaatcccaaaaatatatgagaaactcccacaactgatagtaaaaaatatctgcccaattaaaaacagtctaaatgatgcagaaaaaaattaaattaaaaatgtttttttaaatgtgctaagaacttgaatagacatttctccaaacagatggccaacagatacatgaaaaaaaagttcagtgtcactaggcatcaaggaaatgcaaatcaaaaccactatgaggtatcagtcacttcacacctttcaggatggctatc

SEQ ID NO: 67701 - DNA, 462 bp, Homo sapiens
gaccttaatccaatggctggtgtccttataaggagagggagatgttttaaattttattattatttttatattattgagacagagttttgtggcccaggctggagtgcagtggagcaatcttggctcactgcaacctctgccccatgggttcaagcgattctcctgcctcagtctcccaagtagctgggattataggcactcgccaccccacccagctaattttttgtatttttagtacagatggggtttcaccatgttggccaggctggtctcgaactcctgacctcaagtgatctgcctgccttgctctcccagagtgctgggattacaggcatgagccaccgtgcccagctggagagggagatttgaatacagacacacacacagaggataaggccatgtgaggacacagacacagagggaagacagctgtgtaaagatggaaccagaggttggagtgat

SEQ ID NO: 67702 - DNA, 349 bp, Homo sapiens
caaagtgagatgtgtgagtgcgtgtgtgcgtgtctgccctctcatgcatagatgtgtgcatgtgtgtgtacatacatgtgtgggcgtgcacacagatgcacgcgtgagtgtgagaacgcacgcactgtgaacagccgtgtgactcatttcaaacagtccccttctcccaccctggagcgagtgggttgcactggccaccagcagtgttggacctggagctggtgtggacagtggaatggcaagcccagctggcatggtccttcctgctttcatggccttccccactgctcctccctttctctctctctctctgtatatatctatagatagatagatagccggccccttc

SEQ ID NO: 67703 - DNA, 387 bp, Homo sapiens
gccagagtagtaggaggcgtactggaatataaagccagaaggatgcatttcacaaaagaacattgctaaatcctgccaagactcaaaatgaggacagaaaagtgtacattgaatttggcagtgtgaactattcatagtaatttctgtgtaatggtgagacagaagccagactgtaggggataagaagtgaatggaacaaataagtagactactatttattacacattatatatcgttacttataaaatgtgtgactgtgatgtgaaggagagaagcattggttagaggagagaatatgggctcaaaggaaggagggtcttgtatttttatgagaaaattttgagcattcagaagaaatctgctagagaagagattgaagatactgaa

SEQ ID NO: 67704 - DNA, 239 bp, Homo sapiens
tccagactgaatcctggaaaagaaaaggtatattggtggaaagtgtaattaatagtattgcaacaatgttaatttcttaattctcataaggtactgtggttatacaagaagtttacaataagggaagcttggtgaatgatatgcgaactctatgctagctttgcaactcttctctaagtataaaattatttcaaaataaaaataaagctgcagggaagaaatcaggtcacctacagaaa

SEQ ID NO: 67705 - DNA, 395 bp, Homo sapiens
acatctgggggaagggcaatctggacagaaaggacagcttgtggaaagaccgaaggctgcagtagagggcaagtctcagatgaccagccattaacaggtcctgactctgcaggccctggcgggactctggcccttcctctcagtgaaagggacaccttcggagggtcttgagccaaggagggacaggatctgacttagaatgttttaaaaaatgtttgttattgtaaactaaaacacaggcacagaaaatcttgctgaacagattagagcgtaatgaatcattattaggcaaaccagacctgaaactaccatgcagaactttgccagcctccccagaaaccccttcaggtgcccccatcaaaaccacagcctctccctccctctaaaagcggccg

SEQ ID NO: 67706 - DNA, 550 bp, Homo sapiens
aaggcacccacctggtggattgaggagggcagagggtcaggccaggtggcggatgagggaagcctgggggatccctgcattgagagagtgcagggattcttgatggcttgacagtggggaccctgtgaccaggctgagaattctgttgaataatgaaagcatttggcccactctctaaaatgcttatcgattatgatcaaaaatgatctttctttgagattattatgatcctgtggagggagactgtcaggtaagaattgtgaaagactttgcagtgtgccataaaaaggattactgagtgtctcatctagcgcccttcagggttatctgattcgatagggacccgcgctttccatcgtctttgggctacttatctctgtaaattgtagaaatcttatagtagtgcactttgagtaatgcaaatttcttttccaaagaaatgcaaataaatgcaaattttatcctgtagaatataaatatggctattgctctgcagatactgacccgttttgcatctatttataaattcatttttgcactatcaaaatgt

SEQ ID NO: 67707 - DNA, 179 bp, Homo sapiens
gggtctcctggccccagaattgagactgctgagggaaggaagggcctgctgagttcccagagttatggctgggtcatggcattgggacccacactggcagctccagttacacagggctgggctggcaagggaagggaggatggtgcaggtcaatgcagcagttcagggagcaagtaaga

SEQ ID NO: 67708 - DNA, 2898 bp, Homo sapiens
  misc_feature (922)..(922): n is a, c, g, or t
  misc_feature (1322)..(1322): n is a, c, g, or t
  misc_feature (1499)..(1499): n is a, c, g, or t
  misc_feature (1568)..(1568): n is a, c, g, or t
  misc_feature (1981)..(1981): n is a, c, g, or t
gggtctcctggccccagaattgagactgctgagggaaggaagggcctgctgagttcccagagttatggctgggtcatggcattgggacccacactggcagctccagttacacagggctgggctggctctagcagccttgtcttacttgctccctgaactgctgcattgacctgcaccatcctcccttcccttgccagccgagaactgtgctcctcaggtttcctgggcagggtccagggctctgatgccaaacgcagcctggaaactctagctctcagcatgccaggatgcgggcacccaagtgaggccgcctgggatgcaggaagcttagtccaggcctgggcatgcctctgttccatctcccctcaagcaggaccagctacttaatctgcgggacccagagcagaatgaaaatgtgggcccctcattcaaaaatttaaaatttccaacaaaagaatgaaaaaataagaaaaaattaagaatttcaagatggtgatggcagagtatttaacacttcaaatcatgacccttactgtccaggtcacatgcccacaaagtcagccctgtcgtcaggccttggtttccttgtctgtcaagtgggagaatggtagccactggccaaaagggtgagggtgagaatgaggtgggagctggtggtaagaggtccagtgaacagcatgaggatgaggtaagagtctccgagttcatgatttgttatctgggtctcagcaccgggtggcaggccaaactccttgccaggagtttgattgcttacaacagctctttttcacagaaccaaaaaactaaaaatccatgaagcaaagtaacttgctcagggtcacacagagactcagtgggggaagccaagatcagagttctggcctggctctcttcgaagctggtgctttttgtgacccaggcnggagagagagaagcgcaggagggaggtgggatggggacaggctgctcaggacaaagagggccactgtgcagacacaaagacctgaccacagaggcccctctgggggctgggacagacaaatggatggagccctgtgactctatctgtggtgactggggtagctgccaggagctgcctcctagaccctacctggttgtgatgagggttggggagggtgttggtgtgcaggaaccaggaaatgggtcagggaggagaaacaaactcagagatgggccccttccccactccccaggcctctgaccccatctccccctagctcctcctgggcagcctgccagcttatggaatctcccacaaaccatccaccgccccacattcctccttctcagtgagggtgagnctcaggcaactcactgtctggcagtcccagcctcacaatacttctgacccttccccatcaccagtggcaggatgaagcatatgccctcggcgcagtgtccttcagggccctgtgtgacctgccctgctgacctttcttcactcacctgtccccactcctcctcagccttctacgctncagtcacatggaacgtcccaccattctccaaacactctgtcctttcatacacacgcccccatgttggcncatgcttttccttcttcctggggggctgtttcccctgctccagtagactgaaatcccatttctcctccatgaaccagctcaaatgccacctccagtagccagctttcctccatgcccacagttgggtttagcttcgctcattaacctgttaatcacacatgttgggttcacccactctagcggtgctcctcccacgctggcttgtgttgtagttgttccaatccacaaagcctacctggaagaggggacctttgagctgggccttacaggacaggtggacttcactagtgaatgtcagtggtaagaagtgacaggagctcaaagaatcagggatatcagccctatctccaaaattttatctgcatcagccaggttgctgagttcaaatagcaaggagtctatagttcagaatngcaggagttgagtgtgcagggacactgtcaagggataaagttaagaggttcaccagggccaagccacgaagggttttataatgccatactaaggaatttttttgcttgcttgtttaaaacacatttgaatttatttctcagctctatagtttactaagtaattaagttctggcttttatctttactattttctccctcttaattaccttggcctcccaaagtcctgggattacaggcgtgagccaccgtacctgacccctgtccctgaacatttgtcacaatatattatgagtgaatgagtaagaactctattttagtggtcaccttctttgtgctagtcattaagtttaaggtatctcgcttaatattctccagaaccctgtgagataggcattattttattctcatgtgacatgtagagaaacaggttcagaaaggggaagcgaaagtccaaagcagtgaatctgcggtgggtctcctggccccagaattgcagcctgatgggaaggaaggccctgctgagttcccagagttatggctgggtcatggcattgggacccacactggcagctccagttacacagggctgggctggctctagcagccttgtcttacttgctccctgaactgctgcattgacctgcaccatcctcccttcccttgccagccgagaactgtgctcctcaggtttcctgggcagggtccagggctctgatgccaaacgcagcctggaaactctagctctcagcatgccaggatgcgggcacccaagtgaggccgcctgggatgcaggaagcttagtccaggcctgggcatgcctctgttccatctcccctcaagcaggaccagctacttaatctgcgggacccagagcagaatgaaaatgtgggcccctcattcaaaaatttaaaatttcc

SEQ ID NO: 67709 - DNA, 326 bp, Homo sapiens
aaggattaagtgcttaaaagaaatctttgcttacacaagttgaactgactgctgctaaacttcggatcgactgagggtaaactacatccctgaccttcctttcttcctcaacctgggctctatttactcactgcaggtgcagctcagtcctgctctggtggcactgccccacctgggtgctgccggctgcctggtgaggtcaagagaagcagcccagcaaggagcttcctccactcatacaggacttggtctcaaacaaatgtagcacgacactaagtttaaaagcctaagatcgccttttctcacagaaatctttattttttcca

SEQ ID NO: 67710 - DNA, 411 bp, Homo sapiens
  misc_feature (275)..(275): n is a, c, g, or t
  misc_feature (308)..(308): n is a, c, g, or t
  misc_feature (340)..(340): n is a, c, g, or t
cagcactggcatacttctttctctcttaaagagttagtaaaacatcctcgtttttgttttttctcactgcatgcattatacatattacagaaactttaaaaagtataaataagggaaaaagaaaaataatacctattactaaatttgatttagcaaataaaaattcaggctttagcaagttttaaaaaatgaataatttttatagtataagcatatccctaatattgcataagatatactttcttgaaaacacctgtaagatccattagtattangacaacttttaaagaaatcaccatttcatctgnttgcactaagtcatgccactttcttaaacctnaattggggtttggtttatatgtaacctctaaaacttcagaggtataattaccatcatggggccagtatggg

SEQ ID NO: 67711 - DNA, 2348 bp, Homo sapiens
  misc_feature (2347)..(2347): n is a, c, g, or t
tactaagagtctccagcatcctccacctgtctaccaccgagcatgggcctatatttgaagccttagatctctccagcacagtaagcaccaggagtccatgaagaagatggctcctgccatggaatcccctactctactgtgtgtagccttactgttcttcggtaagtagagattcaattacccctcccagggaggcccaaatgaatttggggagcagctggggtaggaacctttactgtgggtggtgactttttctaggacatgtgcaaactattgggcatttcccagggactctgtagtggagccaagctagaaagcagaggcaagtgggctgagcaacacctaaggaggaagccagactgaaagcttggttccttgcatttgctctggcatcttccagagtgcaaatttcctaccaaggaaatgagggtagaggagagaaagaagctctttcttcccctgattctgattcctgaaaagacggttggtccttaaaattccatggatgtagatcttatccccacacccagattctagtcctctggagataaagaagactgctggacactaatgtatcctctctggacttttgcagctccagatggcgtgttagcaggtgagtcctctgttcttgttcccttggtgtttcaacatgtctgggcattgctttcctctcactattttcttcgtcccatcacttctgctttctaatgagcatgaatctgttccttggccagactactttccctctccaccttgccttgtctttctttttttccctgattcattgcattctctcaagtcattctctcctctgttttagtcaataaccatgtctgttgcacatatacatgtctcattctctctcctagacactttggcatgatctcgctcaataattacattattattattattgccattttataattgaggatgctgaaactcagtgattttctggtggttacatggctaaggaactggatttcaacataagttccttggatctaagtccagttctcttctgactatatcacccttttgttatcaccatgtatctacttctttggtctctgttcaaatttgcactacatccccttgttccaggaagccattcaagactgactttcttagtgcctctcactactttctggaactgacatatgtttttcactctgtatatacttacaattaaatagtcataaatattcagagcttggagaaaccttatatttcatccagtccagtaaatttatccatccataattcactcattcattcacataataaatatttaatgtaacaatggttgaacatggcagacagtgtttctacctcaaaagagattgcagtcctcatttacagatactgaattgaaattaacagaagtagagtgagtcagctcaaatcacatagtgaattggtttctttgtttttaaatctcctgcatatgtgtcctgtctttctccctgtgttgggcgttccctggggcaccaatactaatttctccttcccctagaaatcaaaacagggtcttatcaccaacagaataaggacaggttgaccactgattgtcagaatattgcttcgtttgtacttttaagcctagacagttttcaatgactttttttctctctacatgtcttttcatatttttatcttcttgaagtccctcagaaacctaaggtctccttgaaccctccatggaatagaatatttaaaggagagaatgtgactcttacatgtaatgggaacaatttctttgaagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtggtaagttccagggatatggaaatacagatctctcatgtgagggatggctcatctgaagatgggaaaaaacaggttattccaagggttaggacaccagagtgggattcaaggcctctcatttttaagacccctgcattggctgggcacagtggctcacgcctgtaatcccagcactttgggaggctgaggcaggtggatcacgaggtcaggagatcgagaccatccggctaacatggtgaaaccccatctctgctaaaaaatatatatatataaaattagccgggcgtagtggtgggcacctgtagtcccaggtactcgggaggctgaggcaggagaatggtgtgaacccaggaggtggaggttgcagtgagctgagatcacgccactgccctccagcctgggctacagagcaagactccgtcnc

SEQ ID NO: 67712 - DNA, 1181 bp, Homo sapiens
tactaagagtctccagcatcctccacctgtctaccaccgagcatgggcctatatttgaagccttagatctctccagcacagtaagcaccaggagtccatgaagaagatggctcctgccatggaatcccctactctactgtgtgtagccttactgttcttcgctccagatggcgtgttagcagtccctcagaaacctaaggtctccttgaaccctccatggaatagaatatttaaaggagagaatgtgactcttacatgtaatgggaacaatttctttgaagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtgactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaagctccgcgtgagaagtactggctacaattttttatcccattgttggtggtgattctgtttgctgtggacacaggattatttatctcaactcagcagcaggtcacatttctcttgaagattaagagaaccaggaaaggcttcagacttctgaacccacatcctaagccaaaccccaaaaacaactgatataattactcaagaaatatttgcaacattagtttttttccagcatcagcaattgctactcaattgtcaaacacagcttgcaatatacatagaaacgtctgtgctcaaggatttatagaaatgcttcattaaactgagtgaaactggttaagtggcatgtaatagtaagtgctcaattaacattggttgaataaatgagagaatgaatagattcatttattagcatttgtaaaagagatgttcaatttcactcttatgaatatagaacaaaaaaaaaaaacgactgaaaaaaaagaaagaa

SEQ ID NO: 67713 - DNA, 1072 bp, Homo sapiens
tactaagagtctccagcatcctccacctgtctaccaccgagcatgggcctatatttgaagccttagatctctccagcacagtaagcaccaggagtccatgaagaagatggctcctgccatggaatcccctactctactgtgtgtagccttactgttcttcgctccagatggcgtgttagcagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtgactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaagctccgcgtgagaagtactggctacaattttttatcccattgttggtggtgattctgtttgctgtggacacaggattatttatctcaactcagcagcaggtcacatttctcttgaagattaagagaaccaggaaaggcttcagacttctgaacccacatcctaagccaaaccccaaaaacaactgatataattactcaagaaatatttgcaacattagtttttttccagcatcagcaattgctactcaattgtcaaacacagcttgcaatatacatagaaacgtctgtgctcaaggatttatagaaatgcttcattaaactgagtgaaactggttaagtggcatgtaatagtaagtgctcaattaacattggttgaataaatgagagaatgaatagattcatttattagcatttgtaaaagagatgttcaatttcaataaaataaatataaaaccatgtaacagaatgcttctgagt

SEQ ID NO: 67714 - DNA, 1171 bp, Homo sapiens
tactaagagtctccagcatcctccacctgtctaccaccgagcatgggcctatatttgaagccttagatctctccagcacagtaagcaccaggagtccatgaagaagatggctcctgccatggaatcccctactctactgtgtgtagccttactgttcttcgctccagatggcgtgttagcagtccctcagaaacctaaggtctccttgaaccctccatggaatagaatatttaaaggagagaatgtgactcttacatgtaatgggaacaatttctttgaagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtgactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaagctccgcgtgagaagtactggctacaattttttatcccattgttggtggtgattctgtttgctgtggacacaggattatttatctcaactcagcagcaggtcacatttctcttgaagattaagagaaccaggaaaggcttcagacttctgaacccacatcctaagccaaaccccaaaaacaactgatataattactcaagaaatatttgcaacattagtttttttccagcatcagcaattgctactcaattgtcaaacacagcttgcaatatacatagaaacgtctgtgctcaaggatttatagaaatgcttcattaaactgagtgaaactggttaagtggcatgtaatagtaagtgctcaattaacattggttgaataaatgagagaatgaatagattcatttattagcatttgtaaaagagatgttcaatttcaataaaataaatataaaaccatgtaacagaatgcttctgagt

SEQ ID NO: 67715 - DNA, 2523 bp, Homo sapiens
ccaaggctgtacgctccggagtacgggaggtgagaaatcagggcagattctgtctcccagggaaatacaaggataagggagggcaggggaattattcctgtgcattcctggtgagcctcccctgcccctacttcctccaagacagagaaagctgacccagtctgcagagcccttcttagggttgcctggggggagcaagaaaacctggagctttctttgcacacatttaataatggatcactcagtccttcacactttactgagagaatcattagactcaggtgtccaagtcatcagcttgctttgaactagaactaaacctgccagttgtctgctgaagacagaaatgactcttctgggcatgtaggggagaggacattgtggtggtggggaggggatattaattttgtcgatctggatcaggtttggagggtaaggaggtttagattaccaagctcccctagagggcaggggaagtggctttatgggcacagagtcccaggggatttagtagagagaactgttaaaggccagtttctctgctataagatgttgggagtgactgggtgaggctgggggtgaccactggtgcaggcccaggatgggggctacttgagtgtgcaagagaacctcttttcctctggtaccccagctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggtgagggcaggggcaatgggatgggagggcaaagagggaaggcaacttaggtcttcagagctggggtgggggtgccctctggatgggtagtgaggaggcaggcgtggcctcccacagcccctggccctcccaagggggctggaccagctcctctctgggaggcacccttccttctcccagtctctcaggatctgtgtcctattctctgctgcccataactccaactctgccctctttggttttttctcatgccaccttgtctaagacaactctgccctcttaaccttgattccccctctttgtcttgaacttccccttctattctggcctaccccttggttcctgactgtgccctttccctcttcctctcaggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagataaaaaaaaaaa

SEQ ID NO: 67716 - DNA, 1961 bp, Homo sapiens
caggggaggcccctcggccccacgtcatgtgtgcgtgtgggagcgagcacctccaccaagccgatctcctcgggtcccaagatcacgtcggcaagtcctgcctggcactgcacccccagccaccccatcaggctttgaggaggggccgccctcatcccaatacccctgggctatcgtgtggggtcccaccgtgtctcgagaggatggaggggaccccaactctgccaatcccggatttctggactatggttttgcagcccctcatgggctcgcaaccccacaccccaactcagactccatgcgaggtgatggagatgggcttatccttggagaggcacctgccaccctgcggccattcctgttcgggggccgtggggaaggtgtggacccccagctctatgtcacaattaccatctccatcatcattgttctcgtggccactggcatcatcttcaagttctgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagataaaaaaaaaaa

SEQ ID NO: 67717 - DNA, 2291 bp, Homo sapiens
ccaaggctgtacgctccggagtacgggaggtgagaaatcagggcagattctgtctcccagggaaatacaaggataagggagggcaggggaattattcctgtgcattcctggtgagcctcccctgcccctacttcctccaagacagagaaagctgacccagtctgcagagcccttcttagggttgcctggggggagcaagaaaacctggagctttctttgcacacatttaataatggatcactcagtccttcacactttactgagagaatcattagactcaggtgtccaagtcatcagcttgctttgaactagaactaaacctgccagttgtctgctgaagacagaaatgactcttctgggcatgtaggggagaggacattgtggtggtggggaggggatattaattttgtcgatctggatcaggtttggagggtaaggaggtttagattaccaagctcccctagagggcaggggaagtggctttatgggcacagagtcccaggggatttagtagagagaactgttaaaggccagtttctctgctataagatgttgggagtgactgggtgaggctgggggtgaccactggtgcaggcccaggatgggggctacttgagtgtgcaagagaacctcttttcctctggtaccccagctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggtgagggcaggggcaatgggatgggagggcaaagagggaaggcaacttaggtcttcagagctggggtgggggtgccctctggatgggtagtgaggaggcaggcgtggcctcccacagcccctggccctcccaagggggctggaccagctcctctctgggaggcacccttccttctcccagtctctcaggatctgtgtcctattctctgctgcccataactccaactctgccctctttggttttttctcatgccaccttgtctaagacaactctgccctcttaaccttgattccccctctttgtcttgaacttccccttctattctggcctaccccttggttcctgactgtgccctttccctcttcctctcaggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccatcttccctggctcctaggctgtgatatatatttttgtattatctctttcttcttcttgtggtgatcatcttgaattactgtgggatgtaagtttcaaaattttcaaataaagcctttgcaagataaaaaaaaaaa

SEQ ID NO: 67718 - DNA, 1917 bp, Homo sapiens
ccagcagaacttgaagatgatgccagtggccacgagaacaatgatgctgggaccgcagccagaagcgacgcagaccctcagggcagcaaggtgccctgaggcaggaggagagccagcagccactgacagacctgtccccggctggagtcactgtgctgggggccttcggggactcacctacccccacccctgaccatgaggagccccgagggggaccccggcctgggatgccccaccccaagggggctccagccttccagttgaaccggtgagggcaggggcaatgggatgggagggcaaagagggaaggcaacttaggtcttcagagctggggtgggggtgccctctggatgggtagtgaggaggcaggcgtggcctcccacagcccctggccctcccaagggggctggaccagctcctctctgggaggcacccttccttctcccagtctctcaggatctgtgtcctattctctgctgcccataactccaactctgccctctttggttttttctcatgccaccttgtctaagacaactctgccctcttaaccttgattccccctctttgtcttgaacttccccttctattctggcctaccccttggttcctgactgtgccctttccctcttcctctcaggattcccctggtgaatctgtgatgcccccaatgttggggtgcagccaagcaggaggccaaggggccggcacagcccccatcccactgagggtggggcagctgtggggagctggggccacaggggctcctggctcctgccccttgcacaccacccggaacactccccagccccacgggcaatcctatctgctcgccctcctgcaggtgggggcctcacatatctgtgacttcgggtccctgtccccacccttgtgcactcacatgaaagccttgcacactcacctccaccttcacaggccatttgcacacgctcctgcaccctctccccgtccataccgctccgctcagctgactctcatgttctctcgtctcacatttgcactctctccttcccacattctgtgctcagctcactcagtggtcagcgtttcctgcacactttacctctcatgtgcgtttcccggcctgatgttgtggtggtgtgcggcgtgctcactctctccctcatgaacacccacccacctcgtttccgcagcccctgcgtgctgctccagaggtgggtgggaggtgagctgggggctccttgggccctcatcggtcatggtctcgtcccattccacaccatttgtttctctgtctccccatcctactccaaggatgccggcatcaccctgagggctcccccttgggaatggggtagtgaggccccagacttcacccccagcccactgctaaaatctgttttctgacagatgggttttggggagtcgcctgctgcactacatgagaaagggactcccatttgcccttccctttctcctacagtcccttttgtcttgtctgtcctggctgtctgtgtgtgtgccattctctggacttcagagccccctgagccagtcctcccttcccagcctccctttgggcctccctaactccacctaggctgccagggaccggagtcagctggttcaaggccatcgggagctctgcctccaagtctacccttcccttcccggactccctcctgtcccctcctttcctccctccttccttccactctccttccttttgcttccctgccctttccccctcctcaggttcttccctccttctcactggtttttccaccttcctccttcccttcttccctggctcctaggctgtgatatatatttttgtattatctctttcttcttcttgtggtgatcatcttgaattactgtgggatgtaagtttcaaaattttcaaataaagcctttgcaagataaaaaaaaaaa

SEQ ID NO: 67719 - DNA, 892 bp, Homo sapiens
tgagtgtctacaggggaaagtatagagcacacgaggtctgggatgagactcccagggtttgcatcttgctgtatgaccttgagtagatttttaaacttctgattgcctcagtttactcatttgaaaaatggagataatgctacctagatcatgggttggttgtgagggttgaataagataatacctgggaagcatatgtgctgaataaacatcagctattatcatgatcactttgggccagactccaggagtaagagttctacctcagcccattttttttcaatcctgacaacaccctacaagaatgagtattattttccattctaaaaggttaagtgacttgtttaagggccttagctaataggtgaaggactaggatttgaaaaaatgcagctgagcatggtggctcacgcctatagtcccaacactttgggaggctgaggccagaggatcgcgtgagtccagcagtttgaggccagcctgggcaagatggtgagaccctgtctctatgaaaaaaaaaaaggcgtggtggcacgtgcctgtggttcgagctactcaggaggctgaggtggggaggatcacctaagcccaaggaggttgaggctgcagtgagccatgtttgcgccattgcattccagcctgggcaagagagagacgctgtctcaaaataaaaaagaaacccgatgaatggtgcaaaattttaaatatactcaaacagaagagttataaaaggcctgtggtgcccatcctcagcttcactcattatcagcattctgccagtctctccaaacctacctcccacctcaatcctgtgactggctagtatagtattgtaccttgaaatgtctccagcagtttaaggccgacgagaaccttttttaaaaaacataac

SEQ ID NO: 67720 - DNA, 594 bp, Homo sapiens
gaatcgttcccacggcttctgggtacccttagttccctgcttaggagggaagacagtagtcgggtcgtaataagcaagacttagcccgagcctccgttgccaacgcaggctgccttgcttggcgtgtgggcatcggcctgccccctcaccctggctacccaacacagctacaaaaggcagggaacaatgtaggtcccttggccctgcctaatgcctgttgccatggaaacccctatcctaatctggccaggagccccttgcagtgagccaggagagtgaggaagaggggatggggcccgctggccctgacctggccagaggaggtaatggttaaccggattgtgggagcagctgactagagccgggggggtagggaggcttgggccccagtcctaccttccctgccaaggagaaaggggcatgtctgcttttgtacctctgggaatctacctcagggatctgcccaacaactcccaggttccaagtgccccaggacccaaagattcccatatagcacaccaccttcagcaaaaatatggtggaagttagccacattctttaattctccctttttttctgccttgatggtaaaaa

SEQ ID NO: 67721 - DNA, 591 bp, Homo sapiens
caaagaaaaggagtaacaggctgggtgcggtggctcacgcctataatcccaacattcagggattacaggcatgagccaccatgcccggctgtttttttaagatagaaaaatatacttcatgtatagcctattgacagataatgactgatattttttcttatagataacacataataaacattgtgaagactaataagtaacttgcttattcttttcagttctaaaacctgtaggaaagaatctttagaagctgtcaacaagttgataatgtagcccaatctctacccatgataggagagtaaggcttatatattttatagtagggcactaaatacaggaaccatgtatttaaaaactttttagtgattatctcagaattctaggtgtccctctgctgtacatccctaaattttttgcgtaggtattattaataaattcattattttcaaagatggactgtgttctgtaaaaagcttttccagtatctgcaaatcacacagttttttttaactctattactattatataaaatgatttcttaatattgaaccaaccttgcattcctagaataaacctcacttagccatgatg

SEQ ID NO: 67722 - DNA, 4428 bp, Homo sapiens
gcttccggcctttgtgggtcacttttgatgggttccgggtcccaaaagggttcgaggcctcttgccttcgctccgtaggagggagttctcttctggccctgggggccgcaggactgtccaggaatacagtttccaggtgagatcttacttgaaacaccggtagttctagcacagctaaaatggcatctacttgggctatccaggcccacatggaccaggatgaacctttggaagtaaagatagaggaagagaaatataccaccagacaggattgggacctgcgtaaaaacaacacccatagcagagaggtcttccgtcagtacttcagacagttctgctaccaggagacatctggtccccgtgaggctttgagccgactccgagaactttgccatcagtggctgaggccagagacccacaccaaagaacagattctggagctgctggtgctggagcagttcctgaccatcctacctgaggagctccaggcctgggtgcaggagcagcatccagagagtggggaggaggtggtgactgtgctggaggatttagagagagaactggatgaaccaggagagcaggtctcagtccacactggggaacaggaaatgttcttgcaggagacggtacgtctacgaaaagaaggagaacccagtatgtccctccagtccatgaaagcccagccaaagtatgaatctccagaacttgaatcccaacaggagcaagttttagatgttgagactggaaatgagtatgggaatttaaagcaagaagtttctgaagaaatggaaccacatgggaagacatccagtaaatttgaaaatgatatgtccaagtctgctaggtgtggagaaactcgtgaacctgaagaaataacagaagagccctctgcttgctccagagaagataaacaacctacctgtgatgaaaatggagtaagcctgactgagaactctgaccatactgaacatcagagaatctgtccaggagaagaatcttacggatgtgatgactgtggaaaagcttttagtcagcactcacacctcatagaacatcagaggatccatactggagacagaccctacaaatgcgaagaatgtggaaaagctttccgtgggagaactgtgcttattcgacacaaaataatacacactggagagaaaccgtataagtgtaatgaatgtggcaaagcctttggccggtggtcagctcttaaccaacatcagagacttcacacaggagaaaaacactatcactgtaatgactgtggcaaagcctttagtcagaaagcaggcctctttcaccatatcaagatccacacaagagacaaaccttatcagtgcactcagtgtaataaaagttttagtcggcgttccatacttactcagcatcaaggagttcataccggcgccaagccgtatgagtgcaacgagtgtggaaaagcctttgtttataactcatcccttgtttcccatcaggaaatccaccacaaagaaaaatgctatcagtgtaaggaatgtgggaaatccttcagtcagagtggccttattcagcatcagagaattcacactggggaaaaaccctacaaatgtgacgtatgtgaaaaagcctttattcaaaggacaagtcttacagaacatcagcgaattcacactggagaaagaccctataaatgtgataagtgtgggaaggcgtttactcaaagatcagtcctcacggaacatcagagaatccacactggagagaggccctacaagtgtgatgagtgtgggaatgccttccgaggaatcaccagcctcattcagcatcagagaatccacactggggagaagccctaccaatgtgatgagtgtggaaaagccttcagacagaggtaaacaagacattaagtgtttaaggcaaaaagcatggagaggttggggaagagccaagtttcctaaagtaatgaaaagtgaggaagaagaccagctacaaggaaatacttctgaaaaatcactctgaaccccaagctggagtgaatcttctcctgagctctctcattccagaatggcaatcttgtttcaggagagatctctaatagtgactgatggtaaaggaagaaggctgtgcctagaacaaagaatcaggctggcaaagaaatcacaggtctttcctcaaactttaaattgctactctctggagatagctacctggactttacagagctgtcagaagacttgggaaggtttgccagcattggaaaaagccacttggacttcacagagctgtcagaagacttaggaagctttgccagtagttcctgagaccagaaatacatattatgaagcaggtgctggaacaggccctggcccctacttgtgaagctgcagatatagatggtgttactgagaaggaaactaaggacttggctccaaaacaaaacaaaacaaaatctggagatgctgaattttgttggggggaatgtctgtagaactgcaacatcaatgcagtaagtgtagtaaaagctttagtttatggtgagtcattactcagcatcatggagtccacgatgaagagaatctcttttcaatctgtgcaatcaacaagtttttgaaaggcttttgtttatagtggaaccctcttttccccctagaagaaccaccacaaggaaaaatgctgtcaccataaggaatgtgggaaagttttcagccacatggccttatttgacttcaaagaatccacatgagagagagactgcataaatgtaataactgaggaggcctttgttcagcaaagaaaccttatacaaactcgtataaagaatgtaggaagaccttcacccagaagccaggactgactgtgcaccagagaatctgcacaataaacatgatgaatgtggagatgcttgcttcagcattggagaattcacagtaaacggaaaccctgccagtgtgatgagtacggaaaagtcttcagaggttggaacttgggaaaaatcagtgagtgaattcatattagagaggctcttataaatgagaggattgtggaaacttgtatagacagagatcagacctcaacaagggagcctccacagtattgaaaagttaatataattaatgtaagtgggcaagttgtatggggaatgggtagtctaaattgctcattttagccagtaaaaacattaaattagtttcttagatcaagaaaaggaaatgttagaagttatttttcccttccagaggggtctatatgtgtaagcaaccaggacttttgaaataagttgcatctctggatttgtgatctgtctcctggatgattatctctgttttgggagacaggtattttttcttcatgcctgctctagtctcatctcatatctttaattcattcagcaagtatacacaatagtattatcgtctactgtttgttgtaaatatatatatattattttctttttggtctgagtaggcttgtattggtaccctaggacataaaaatcacatatatcatgtttcagtaaatgcagtgaaaggaactatattattaaattgctgggaatttctgtaaatttgagactacctttatattctccaacacaagaccgtgtaggtgtcccttcagagagtatatttttctagcttggcttctttattttctttatttttttgagatggagtcttgctcctgtcgcccaggctggagtgcaatggcacgatctcggctcactgcaacctccgcctcccaggttcaagtgattctcctgtctcagtctcccgagtagctgggattacaggcacttgccaccattcccagctaatttttgtatttttagtagagacggggtttcaccatgttggccaggctggtctcgaactcctgaccttgtgatctgcccaccttggcctcccaaagttcagggattacaggcatgagccaccatgcccggctgtttttttaagatagaaaaatatacttcatgtatagcctattgacagataatgactgatattttttcttatagataacacataataaacattgtgaagactaataagtaacttgcttattcttttcagttctaaaacctgtaggaaagaatctttagaagctgtcaacaagttgataatgtagcccaatctctacccatgataggagagtaaggcttatatattttatagtagggcactaaatacaggaaccatgtatttaaaaactttttagtgattatctcagaattctaggtgtccctctgctgtacatccctaaattttttgcgtaggtattattaataaattcattattttcaaagatggactgtgttctgtaaaaagcttttccagtatctgcaaatcacacagttttttttaactctattactattatataaaatgatttcttaatattgaaccaaccttgcattcctagaataaacctcacttagccatgatg

SEQ ID NO: 67723 - DNA, 2583 bp, Homo sapiens
cagccgttgacggcagcggcacgtgaaagtaccgacctttctggcctttgtgacggacctttggaggcgggtggtttcagattcgtgcgctccggcctttcagtgtctctggaagaagaccagctacaaggaaatacttctgaaaaatcactctgaaccccaagctggagtgaatcttctcctgagctctctcattccagaatggcaatcttgtttcaggagagatctctaatagtgactgatggtaaaggaagaaggctgtgcctagaacaaagaatcaggctggcaaagaaatcacaggtctttcctcaaactttaaattgctactctctggagatagctacctggactttacagagctgtcagaagacttgggaaggtttgccagcattggaaaaagccacttggacttcacagagctgtcagaagacttaggaagctttgccagtagttcctgagaccagaaatacatattatgaagcaggtgctggaacaggccctggcccctacttgtgaagctgcagatatagatggtgttactgagaaggaaactaaggacttggctccaaaacaaaacaaaacaaaatctggagatgctgaattttgttggggggaatgtctgtagaactgcaacatcaatgcagtaagtgtagtaaaagctttagtttatggtgagtcattactcagcatcatggagtccacgatgaagagaatctcttttcaatctgtgcaatcaacaagtttttgaaaggcttttgtttatagtggaaccctcttttccccctagaagaaccaccacaaggaaaaatgctgtcaccataaggaatgtgggaaagttttcagccacatggccttatttgacttcaaagaatccacatgagagagagactgcataaatgtaataactgaggaggcctttgttcagcaaagaaaccttatacaaactcgtataaagaatgtaggaagaccttcacccagaagccaggactgactgtgcaccagagaatctgcacaataaacatgatgaatgtggagatgcttgcttcagcattggagaattcacagtaaacggaaaccctgccagtgtgatgagtacggaaaagtcttcagaggttggaacttgggaaaaatcagtgagtgaattcatattagagaggctcttataaatgagaggattgtggaaacttgtatagacagagatcagacctcaacaagggagcctccacagtattgaaaagttaatataattaatgtaagtgggcaagttgtatggggaatgggtagtctaaattgctcattttagccagtaaaaacattaaattagtttcttagatcaagaaaaggaaatgttagaagttatttttcccttccagaggggtctatatgtgtaagcaaccaggacttttgaaataagttgcatctctggatttgtgatctgtctcctggatgattatctctgttttgggagacaggtattttttcttcatgcctgctctagtctcatctcatatctttaattcattcagcaagtatacacaatagtattatcgtctactgtttgttgtaaatatatatatattattttctttttggtctgagtaggcttgtattggtaccctaggacataaaaatcacatatatcatgtttcagtaaatgcagtgaaaggaactatattattaaattgctgggaatttctgtaaatttgagactacctttatattctccaacacaagaccgtgtaggtgtcccttcagagagtatatttttctagcttggcttctttattttctttatttttttgagatggagtcttgctcctgtcgcccaggctggagtgcaatggcacgatctcggctcactgcaacctccgcctcccaggttcaagtgattctcctgtctcagtctcccgagtagctgggattacaggcacttgccaccattcccagctaatttttgtatttttagtagagacggggtttcaccatgttggccaggctggtctcgaactcctgaccttgtgatctgcccaccttggcctcccaaagttcagggattacaggcatgagccaccatgcccggctgtttttttaagatagaaaaatatacttcatgtatagcctattgacagataatgactgatattttttcttatagataacacataataaacattgtgaagactaataagtaacttgcttattcttttcagttctaaaacctgtaggaaagaatctttagaagctgtcaacaagttgataatgtagcccaatctctacccatgataggagagtaaggcttatatattttatagtagggcactaaatacaggaaccatgtatttaaaaactttttagtgattatctcagaattctaggtgtccctctgctgtacatccctaaattttttgcgtaggtattattaataaattcattattttcaaagatggactgtgttctgtaaaaagcttttccagtatctgcaaatcacacagttttttttaactctattactattatataaaatgatttcttaatattgaaccaaccttgcattcctagaataaacctcacttagccatgatg

SEQ ID NO: 67724 - DNA, 2648 bp, Homo sapiens
cagccgttgacggcagcggcacgtgaaagtaccgacctttctggcctttgtgacggacctttggaggcgggtggtttcagattcgtgcgctccggcctttcagtgtctctggtgaggttgggcctgataggttgagagctgccaggggaagttaaggatgacttccaagttttgaggaagaagaccagctacaaggaaatacttctgaaaaatcactctgaaccccaagctggagtgaatcttctcctgagctctctcattccagaatggcaatcttgtttcaggagagatctctaatagtgactgatggtaaaggaagaaggctgtgcctagaacaaagaatcaggctggcaaagaaatcacaggtctttcctcaaactttaaattgctactctctggagatagctacctggactttacagagctgtcagaagacttgggaaggtttgccagcattggaaaaagccacttggacttcacagagctgtcagaagacttaggaagctttgccagtagttcctgagaccagaaatacatattatgaagcaggtgctggaacaggccctggcccctacttgtgaagctgcagatatagatggtgttactgagaaggaaactaaggacttggctccaaaacaaaacaaaacaaaatctggagatgctgaattttgttggggggaatgtctgtagaactgcaacatcaatgcagtaagtgtagtaaaagctttagtttatggtgagtcattactcagcatcatggagtccacgatgaagagaatctcttttcaatctgtgcaatcaacaagtttttgaaaggcttttgtttatagtggaaccctcttttccccctagaagaaccaccacaaggaaaaatgctgtcaccataaggaatgtgggaaagttttcagccacatggccttatttgacttcaaagaatccacatgagagagagactgcataaatgtaataactgaggaggcctttgttcagcaaagaaaccttatacaaactcgtataaagaatgtaggaagaccttcacccagaagccaggactgactgtgcaccagagaatctgcacaataaacatgatgaatgtggagatgcttgcttcagcattggagaattcacagtaaacggaaaccctgccagtgtgatgagtacggaaaagtcttcagaggttggaacttgggaaaaatcagtgagtgaattcatattagagaggctcttataaatgagaggattgtggaaacttgtatagacagagatcagacctcaacaagggagcctccacagtattgaaaagttaatataattaatgtaagtgggcaagttgtatggggaatgggtagtctaaattgctcattttagccagtaaaaacattaaattagtttcttagatcaagaaaaggaaatgttagaagttatttttcccttccagaggggtctatatgtgtaagcaaccaggacttttgaaataagttgcatctctggatttgtgatctgtctcctggatgattatctctgttttgggagacaggtattttttcttcatgcctgctctagtctcatctcatatctttaattcattcagcaagtatacacaatagtattatcgtctactgtttgttgtaaatatatatatattattttctttttggtctgagtaggcttgtattggtaccctaggacataaaaatcacatatatcatgtttcagtaaatgcagtgaaaggaactatattattaaattgctgggaatttctgtaaatttgagactacctttatattctccaacacaagaccgtgtaggtgtcccttcagagagtatatttttctagcttggcttctttattttctttatttttttgagatggagtcttgctcctgtcgcccaggctggagtgcaatggcacgatctcggctcactgcaacctccgcctcccaggttcaagtgattctcctgtctcagtctcccgagtagctgggattacaggcacttgccaccattcccagctaatttttgtatttttagtagagacggggtttcaccatgttggccaggctggtctcgaactcctgaccttgtgatctgcccaccttggcctcccaaagttcagggattacaggcatgagccaccatgcccggctgtttttttaagatagaaaaatatacttcatgtatagcctattgacagataatgactgatattttttcttatagataacacataataaacattgtgaagactaataagtaacttgcttattcttttcagttctaaaacctgtaggaaagaatctttagaagctgtcaacaagttgataatgtagcccaatctctacccatgataggagagtaaggcttatatattttatagtagggcactaaatacaggaaccatgtatttaaaaactttttagtgattatctcagaattctaggtgtccctctgctgtacatccctaaattttttgcgtaggtattattaataaattcattattttcaaagatggactgtgttctgtaaaaagcttttccagtatctgcaaatcacacagttttttttaactctattactattatataaaatgatttcttaatattgaaccaaccttgcattcctagaataaacctcacttagccatgatg

SEQ ID NO: 67725 - DNA, 2780 bp, Homo sapiens
gcttccggcctttgtgggtcacttttgatgggttccgggtcccaaaagggttcgaggcctcttgccttcgctccgtaggagggagttctcttctggccctgggggccgcaggactgtccaggaatacagtttccaggtgagatcttacttgaaacaccggtagttctagcacagctaaaatggcatctacttgggctatccaggcccacatggaccaggatgaacctttggaagtaaagatagaggaagagaaatataccaccagacaggattgggacctgcgtaaaaacaacacccatagcagagaggtcttccgtcagtacttcagacagttctgctaccaggagacatctggtccccgtgaggctttgagccgactccgagaactttgccatcagtggctgaggccagagacccacaccaaagaacagattctggagctgctggtgctggagcagttcctgaccatcctacctgaggagctccaggcctgggtgcaggagcagcatccagagagtggggaggaggtggtgactgtgctggaggatttagagagagaactggatgaaccaggagagcaggtctcagtccacactggggaacaggaaatgttcttgcaggagacggtacgtctacgaaaagaaggagaacccagtatgtccctccagtccatgaaagcccagccaaagtatgaatctccagaacttgaatcccaacaggagcaagttttagatgttgagactggaaatgagtatgggaatttaaagcaagaagtttctgaagaaatggaaccacatgggaagacatccagtaaatttgaaaatgatatgtccaagtctgctaggtgtggagaaactcgtgaacctgaagaaataacagaagagccctctgcttgctccagagaagataaacaacctacctgtgatgaaaatggagtaagcctgactgagaactctgaccatactgaacatcagagaatctgtccaggagaagaatcttacggatgtgatgactgtggaaaagcttttagtcagcactcacacctcatagaacatcagaggatccatactggagacagaccctacaaatgcgaagaatgtggaaaagctttccgtgggagaactgtgcttattcgacacaaaataatacacactggagagaaaccgtataagtgtaatgaatgtggcaaagcctttggccggtggtcagctcttaaccaacatcagagacttcacacaggagaaaaacactatcactgtaatgactgtggcaaagcctttagtcagaaagcaggcctctttcaccatatcaagatccacacaagagacaaaccttatcagtgcactcagtgtaataaaagttttagtcggcgttccatacttactcagcatcaaggagttcataccggcgccaagccgtatgagtgcaacgagtgtggaaaagcctttgtttataactcatcccttgtttcccatcaggaaatccaccacaaagaaaaatgctatcagtgtaaggaatgtgggaaatccttcagtcagagtggccttattcagcatcagagaattcacactggggaaaaaccctacaaatgtgacgtatgtgaaaaagcctttattcaaaggacaagtcttacagaacatcagcgaattcacactggagaaagaccctataaatgtgataagtgtgggaaggcgtttactcaaagatcagtcctcacggaacatcagagaatccacactggagagaggccctacaagtgtgatgagtgtgggaatgccttccgaggaatcaccagcctcattcagcatcagagaatccacactggggagaagccctaccaatgtgatgagtgtggaaaagccttcagacagaggtaaacaagacattaagtgtttaaggcaaaaagcatggagaggttggggaagagccaagtttcctaaagtaatgaaaagtgaggaagaagaccagctacaaggaaatacttctgaaaaatcactctgaaccccaagctggagtgaatcttctcctgagctctctcattccagaatggcaatcttgtttcaggagagatctctaatagtgactgatggtaaaggaagaaggctgtgcctagaacaaagaatcaggctggcaaagaaatcacaggtctttcctcaaactttaaattgctactctctggagatagctacctggactttacagagctgtcagaagacttgggaaggtttgccagcattggaaaaagccacttggacttcacagagctgtcagaagacttaggaagctttgccagtagttcctgagaccagaaatacatattatgaagcaggtgctggaacaggccctggcccctacttgtgaagctgcagatatagatggtgttactgagaaggaaactaaggacttggctccaaaacaaaacaaaacaaaatctggagatgctgaattttgttggggggaatgtctgtagaactgcaacatcaatgcagtaagtgtagtaaaagctttagtttatggtgagtcattactcagcatcatggagtccacgatgaagagaatctcttttcaatctgtgcaatcaacaagtttttgaaaggcttttgtttatagtggaaccctcttttccccctagaagaaccaccacaaggaaaaatgctgtcaccataaggaatgtgggaaagttttcagccacatggccttatttgacttcaaagaatccagtgagccgagatcatgctactgcactccagcctgggcgacaagagcaaaactccccgtca

SEQ ID NO: 67726 - DNA, 2029 bp, Homo sapiens
gcttccggcctttgtgggtcacttttgatgggttccgggtcccaaaagggttcgaggcctcttgccttcgctccgtaggagggagttctcttctggccctgggggccgcaggactgtccaggaatacagtttccaggtgagatcttacttgaaacaccggtagttctagcacagctaaaatggcatctacttgggctatccaggcccacatggaccaggatgaacctttggaagtaaagatagaggaagagaaatataccaccagacaggattgggacctgcgtaaaaacaacacccatagcagagaggtcttccgtcagtacttcagacagttctgctaccaggagacatctggtccccgtgaggctttgagccgactccgagaactttgccatcagtggctgaggccagagacccacaccaaagaacagattctggagctgctggtgctggagcagttcctgaccatcctacctgaggagctccaggcctgggtgcaggagcagcatccagagagtggggaggaggtggtgactgtgctggaggatttagagagagaactggatgaaccaggagagcaggtctcagtccacactggggaacaggaaatgttcttgcaggagacggtacgtctacgaaaagaaggagaacccagtatgtccctccagtccatgaaagcccagccaaagtatgaatctccagaacttgaatcccaacaggagcaagttttagatgttgagactggaaatgagtatgggaatttaaagcaagaagtttctgaagaaatggaaccacatgggaagacatccagtaaatttgaaaatgatatgtccaagtctgctaggtgtggagaaactcgtgaacctgaagaaataacagaagagccctctgcttgctccagagaagataaacaacctacctgtgatgaaaatggagtaagcctgactgagaactctgaccatactgaacatcagagaatctgtccaggagaagaatcttacggatgtgatgactgtggaaaagcttttagtcagcactcacacctcatagaacatcagaggatccatactggagacagaccctacaaatgcgaagaatgtggaaaagctttccgtgggagaactgtgcttattcgacacaaaataatacacactggagagaaaccgtataagtgtaatgaatgtggcaaagcctttggccggtggtcagctcttaaccaacatcagagacttcacacaggagaaaaacactatcactgtaatgactgtggcaaagcctttagtcagaaagcaggcctctttcaccatatcaagatccacacaagagacaaaccttatcagtgcactcagtgtaataaaagttttagtcggcgttccatacttactcagcatcaaggagttcataccggcgccaagccgtatgagtgcaacgagtgtggaaaagcctttgtttataactcatcccttgtttcccatcaggaaatccaccacaaagaaaaatgctatcagtgtaaggaatgtgggaaatccttcagtcagagtggccttattcagcatcagagaattcacactggggaaaaaccctacaaatgtgacgtatgtgaaaaagcctttattcaaaggacaagtcttacagaacatcagcgaattcacactggagaaagaccctataaatgtgataagtgtgggaaggcgtttactcaaagatcagtcctcacggaacatcagagaatccacactggagagaggccctacaagtgtgatgagtgtgggaatgccttccgaggaatcaccagcctcattcagcatcagagaatccacactggggagaagccctaccaatgtgatgagtgtggaaaagccttcagacagaggtaaacaagacattaagtgtttaaggcaaaaagcatggagaggttggggaagagccaagtttcctaaagtaatgaaaagtgagatagaagaccagctagcaaggagagtatttctgccccatcactctgacatcaatgctgggtgacttcgctgta

SEQ ID NO: 67727 - DNA, 248 bp, Homo sapiens
ggtagggttatggcaggcttatatctgggaaaaaggtcatttcagggttcagccactgccacaaatagtatactttttgttttctgttatcagagtgagtctgtcagctacatctcattttcctcaggtctcagtccacactggggaacaggaaatgttcttgcaggagacggtacgtctacgaaaagaaggagaacccagtatgtccctccagtccatgaaagcccagccaaagtatgaatctccag

SEQ ID NO: 67728 - DNA, 439 bp, Homo sapiens
gcggcacgtgaaagtaccgacctttctggcctttgtgacggacctttggaggcgggtggtttcagattcgtgcgctccggcctttcagtgtctctggtgaggttgggcctgataggttgagagctgccaggggaagttaaggatgacttccaagttttgaggtatcaggaaaactggctgttgagaaaaaggagtctgggttccccgtttggtgaaaggaaagttgggttcatttggggaaattatgtgattcatgattttcccaagatcgacgctgagtacaagaaaagacagaatccacctagctgttgtgtgactttgagcaaattacttaatctctctgtgcctcagttttattcctctgtcagtgagattataagtgtctacttaaatggctgcatgcatggtgcattttaaataaatattagctgttgttatt

SEQ ID NO: 67729 - DNA, 347 bp, Homo sapiens
agaatgtggagacgaggcaatcgatgatgctggaaaagttgaagagagagtttgaatgaaggacaaaccaccgatgggaaagcttgggaggatcacttataggcttgactagcaaaaggctttgggaataggatagaaagcagcaaacctgaactttaggatccaccagatgtctctggagccataacccaacatttcccataaatagtaggttttaattctcctgctatttaggtgcatctctgggacctcctctttctatattgggttttttgtttgttgggtgttttaacttaggatttagcttcaaattccatttcccaagaccaattttatcacattgcctt

SEQ ID NO: 67730 - DNA, 5641 bp, Homo sapiens
gcttccggcctttgtgggtcacttttgatgggttccgggtcccaaaagggttcgaggcctcttgccttcgctccgtaggagggagttctcttctggccctgggggccgcaggactgtccaggaatacagtttccaggtgagatcttacttgaaacaccggtagttctagcacagctaaaatggcatctacttgggctatccaggcccacatggaccaggatgaacctttggaagtaaagatagaggaagagaaatataccaccagacaggattgggacctgcgtaaaaacaacacccatagcagagaggtcttccgtcagtacttcagacagttctgctaccaggagacatctggtccccgtgaggctttgagccgactccgagaactttgccatcagtggctgaggccagagacccacaccaaagaacagattctggagctgctggtgctggagcagttcctgaccatcctacctgaggagctccaggcctgggtgcaggagcagcatccagagagtggggaggaggtggtgactgtgctggaggatttagagagagaactggatgaaccaggagagcaggtctcagtccacactggggaacaggaaatgttcttgcaggagacggtacgtctacgaaaagaaggagaacccagtatgtccctccagtccatgaaagcccagccaaagtatgaatctccagaacttgaatcccaacaggagcaagttttagatgttgagactggaaatgagtatgggaatttaaagcaagaagtttctgaagaaatggaaccacatgggaagacatccagtaaatttgaaaatgatatgtccaagtctgctaggtgtggagaaactcgtgaacctgaagaaataacagaagagccctctgcttgctccagagaagataaacaacctacctgtgatgaaaatggagtaagcctgactgagaactctgaccatactgaacatcagagaatctgtccaggagaagaatcttacggatgtgatgactgtggaaaagcttttagtcagcactcacacctcatagaacatcagaggatccatactggagacagaccctacaaatgcgaagaatgtggaaaagctttccgtgggagaactgtgcttattcgacacaaaataatacacactggagagaaaccgtataagtgtaatgaatgtggcaaagcctttggccggtggtcagctcttaaccaacatcagagacttcacacaggagaaaaacactatcactgtaatgactgtggcaaagcctttagtcagaaagcaggcctctttcaccatatcaagatccacacaagagacaaaccttatcagtgcactcagtgtaataaaagttttagtcggcgttccatacttactcagcatcaaggagttcataccggcgccaagccgtatgagtgcaacgagtgtggaaaagcctttgtttataactcatcccttgtttcccatcaggaaatccaccacaaagaaaaatgctatcagtgtaaggaatgtgggaaatccttcagtcagagtggccttattcagcatcagagaattcacactggggaaaaaccctacaaatgtgacgtatgtgaaaaagcctttattcaaaggacaagtcttacagaacatcagcgaattcacactggagaaagaccctataaatgtgataagtgtgggaaggcgtttactcaaagatcagtcctcacggaacatcagagaatccacactggagagaggccctacaagtgtgatgagtgtgggaatgccttccgaggaatcaccagcctcattcagcatcagagaatccacactggggagaagccctaccaatgtgatgagtgtggaaaagccttcagacagaggaagaagaccagctacaaggaaatacttctgaaaaatcactctgaaccccaagctggagtgaatcttctcctgagctctctcattccagaatggcaatcttgtttcaggagagatctctaatagtgactgatggtaaaggaagaaggctgtgcctagaacaaagaatcaggctggcaaagaaatcacaggtctttcctcaaactttaaattgctactctctggagatagctacctggactttacagagctgtcagaagacttgggaaggtttgccagcattggaaaaagccacttggacttcacagagctgtcagaagacttaggaagctttgccagtagttcctgagaccagaaatacatattatgaagcaggtgctggaacaggccctggcccctacttgtgaagctgcagatataggtaagataatatcatccagaatgtggagacgaggcaatcgatgatgctggaaaagttgaagagagagtttgaatgaaggacaaaccaccgatgggaaagcttgactagcaaaaggctttgggaataggatagaaagcagcaaacctgaactttaggatccaccagatgtctctggagccataacccaacatttcccataaatagtaggttttaattctcctgctatttaggtgcatctctgggacctcctctttctatattgggttttttgtttgttgggtgttttaacttaggatttagcttcaaattccatttcccaagaccaattttatcacattgcctttaggtctcaggctaaatgatataacaagatatgcttttggcaaagatagtaccttggaatgaaaggtttcagatcaaacctaagatcctaccttagtttacctctcagtgttattgccttttgatatggaaagctgatgagagagcatctctggagagaaagaggagagcctcacgggaagcttttagaacttttagtagcatcctctccccagaaaacttgtctctactcatctccttctcattatctacctgattcgttaagtaggaaatctcagccatatttgtaggggattggggttttgttttttttgacccacttaactcctttagcttcaaagtgttgctttcttacattttagacatgaatattacctagaaaatttatttccccactgttaattttccagtttattgatttccccacatcagattagtgtgtattttgaaactggtttagctattgtttcaagttaactttgatcatatcccgttgtttactgatccactcaacaaatatttattgaacattctgtaggtttatagtagtagccaagatacttaaagtgagtagaaatagtccttttaactgtccttaacaaattaaactttctcttggtttcatgatattccttgtttctcagctttggattcaaactgatcttctcttttttgattatactttcctgatttcttttattgtcacatttttgtgaaaagtcttccatgcacttccagtctctttctgcctagctgtctcttctcacccaaattggacccccctactcctaccctgccacgtgccttcacaaaaatgagatgcttgtttagagacttagaaaaggcatgcactttaggtaaaagtggattttatttttaatcactgtaccctatcataaatctcatttcagaagagacaactgacatttgaattgtctgtgcattttgttttagatggtgttactgagaaggaaactaaggacttggctccaaaacaaaacaaaacaaaatctggagatgctgaattttgttggggggaatgtctgtagaactgcaacatcaatgcagtaagtgtagtaaaagctttagtttatggtgagtcattactcagcatcatggagtccacgatgaagagaatctcttttcaatctgtgcaatcaacaagtttttgaaaggcttttgtttatagtggaaccctcttttccccctagaagaaccaccacaaggaaaaatgctgtcaccataaggaatgtgggaaagttttcagccacatggccttatttgacttcaaagaatccacatgagagagagactgcataaatgtaataactgaggaggcctttgttcagcaaagaaaccttatacaaactcgtataaagaatgtaggaagaccttcacccagaagccaggactgactgtgcaccagagaatctgcacaataaacatgatgaatgtggagatgcttgcttcagcattggagaattcacagtaaacggaaaccctgccagtgtgatgagtacggaaaagtcttcagaggttggaacttgggaaaaatcagtgagtgaattcatattagagaggctcttataaatgagaggattgtggaaacttgtatagacagagatcagacctcaacaagggagcctccacagtattgaaaagttaatataattaatgtaagtgggcaagttgtatggggaatgggtagtctaaattgctcattttagccagtaaaaacattaaattagtttcttagatcaagaaaaggaaatgttagaagttatttttcccttccagaggggtctatatgtgtaagcaaccaggacttttgaaataagttgcatctctggatttgtgatctgtctcctggatgattatctctgttttgggagacaggtattttttcttcatgcctgctctagtctcatctcatatctttaattcattcagcaagtatacacaatagtattatcgtctactgtttgttgtaaatatatatatattattttctttttggtctgagtaggcttgtattggtaccctaggacataaaaatcacatatatcatgtttcagtaaatgcagtgaaaggaactatattattaaattgctgggaatttctgtaaatttgagactacctttatattctccaacacaagaccgtgtaggtgtcccttcagagagtatatttttctagcttggcttctttattttctttatttttttgagatggagtcttgctcctgtcgcccaggctggagtgcaatggcacgatctcggctcactgcaacctccgcctcccaggttcaagtgattctcctgtctcagtctcccgagtagctgggattacaggcacttgccaccattcccagctaatttttgtatttttagtagagacggggtttcaccatgttggccaggctggtctcgaactcctgaccttgtgatctgcccaccttggcctcccaaagttcagggattacaggcatgagccaccatgcccggctgtttttttaagatagaaaaatatacttcatgtatagcctattgacagataatgactgatattttttcttatagataacacataataaacattgtgaagactaataagtaacttgcttattcttttcagttctaaaacctgtaggaaagaatctttagaagctgtcaacaagttgataatgtagcccaatctctacccatgataggagagtaaggcttatatattttatagtagggcactaaatacaggaaccatgtatttaaaaactttttagtgattatctcagaattctaggtgtccctctgctgtacatccctaaattttttgcgtaggtattattaataaattcattattttcaaagatggactgtgttctgtaaaaagcttttccagtatctgcaaatcacacagttttttttaactctattactattatataaaatgatttcttaatattgaaccaaccttgcattcctagaataaacctcacttagccatgatg

SEQ ID NO: 67731 - DNA, 3181 bp, Homo sapiens
gcttccggcctttgtgggtcacttttgatgggttccgggtcccaaaagggttcgaggcctcttgccttcgctccgtaggagggagttctcttctggccctgggggccgcaggactgtccaggaatacagtttccaggtgagatcttacttgaaacaccggtagttctagcacagctaaaatggcatctacttgggctatccaggcccacatggaccaggatgaacctttggaagtaaagatagaggaagagaaatataccaccagacaggattgggacctgcgtaaaaacaacacccatagcagagaggtcttccgtcagtacttcagacagttctgctaccaggagacatctggtccccgtgaggctttgagccgactccgagaactttgccatcagtggctgaggccagagacccacaccaaagaacagattctggagctgctggtgctggagcagttcctgaccatcctacctgaggagctccaggcctgggtgcaggagcagcatccagagagtggggaggaggtggtgactgtgctggaggatttagagagagaactggatgaaccaggagagcaggtctcagtccacactggggaacaggaaatgttcttgcaggagacggtacgtctacgaaaagaaggagaacccagtatgtccctccagtccatgaaagcccagccaaagtatgaatctccagaacttgaatcccaacaggagcaagttttagatgttgagactggaaatgagtatgggaatttaaagcaagaagtttctgaagaaatggaaccacatgggaagacatccagtaaatttgaaaatgatatgtccaagtctgctaggtgtggagaaactcgtgaacctgaagaaataacagaagagccctctgcttgctccagagaagataaacaacctacctgtgatgaaaatggagtaagcctgactgagaactctgaccatactgaacatcagagaatctgtccaggagaagaatcttacggatgtgatgactgtggaaaagcttttagtcagcactcacacctcatagaacatcagaggatccatactggagacagaccctacaaatgcgaagaatgtggaaaagctttccgtgggagaactgtgcttattcgacacaaaataatacacactggagagaaaccgtataagtgtaatgaatgtggcaaagcctttggccggtggtcagctcttaaccaacatcagagacttcacacaggagaaaaacactatcactgtaatgactgtggcaaagcctttagtcagaaagcaggcctctttcaccatatcaagatccacacaagagacaaaccttatcagtgcactcagtgtaataaaagttttagtcggcgttccatacttactcagcatcaaggagttcataccggcgccaagccgtatgagtgcaacgagtgtggaaaagcctttgtttataactcatcccttgtttcccatcaggaaatccaccacaaagaaaaatgctatcagtgtaaggaatgtgggaaatccttcagtcagagtggccttattcagcatcagagaattcacactggggaaaaaccctacaaatgtgacgtatgtgaaaaagcctttattcaaaggacaagtcttacagaacatcagcgaattcacactggagaaagaccctataaatgtgataagtgtgggaaggcgtttactcaaagatcagtcctcacggaacatcagagaatccacactggagagaggccctacaagtgtgatgagtgtgggaatgccttccgaggaatcaccagcctcattcagcatcagagaatccacactggggagaagccctaccaatgtgatgagtgtggaaaagccttcagacagaggtaaacaagacattaagtgtttaaggcaaaaagcatggagaggttggggaagagccaagtttcctaaagtaatgaaaagtgaggaagaagaccagctacaaggaaatacttctgaaaaatcactctgaaccccaagctggagtgaatcttctcctgagctctctcattccagaatggcaatcttgtttcaggagagatctctaatagtgactgatggtaaaggaagaaggctgtgcctagaacaaagaatcaggctggcaaagaaatcacaggtctttcctcaaactttaaattgctactctctggagatagctacctggactttacagagctgtcagaagacttgggaaggtttgccagcattggaaaaagccacttggacttcacagagctgtcagaagacttaggaagctttgccagtagttcctgagaccagaaatacatattatgaagcaggtgctggaacaggccctggcccctacttgtgaagctgcagatatagatggtgttactgagaaggaaactaaggacttggctccaaaacaaaacaaaacaaaatctggagatgctgaattttgttggggggaatgtctgtagaactgcaacatcaatgcagtaagtgtagtaaaagctttagtttatggtgagtcattactcagcatcatggagtccacgatgaagagaatctcttttcaatctgtgcaatcaacaagtttttgaaaggcttttgtttatagtggaaccctcttttccccctagaagaaccaccacaaggaaaaatgctgtcaccataaggaatgtgggaaagttttcagccacatggccttatttgacttcaaagaatccacatgagagagagactgcataaatgtaataactgaggaggcctttgttcagcaaagaaaccttatacaaactcgtataaagaatgtaggaagaccttcacccagaagccaggactgactgtgcaccagagaatctgcacaataaacatgatgaatgtggagatgcttgcttcagcattggagaattcacagtaaacggaaaccctgccagtgtgatgagtacggaaaagtcttcagaggttggaacttgggaaaaatcagtgagtgaattcatattagagaggctcttataaatgagaggattgtggaaacttgtatagacagagatcagacctcaacaagggagcctccacagtattgaaaagttaatataattaatgtaagtgggcaagttgtatggggaatgggtagtctaaattgctcattttagccagtaaaaacattaaattagtttcttagatca

SEQ ID NO: 67732 - DNA, 668 bp, Homo sapiens
gaaaaggataggcatacagaatcccccctctggcagggtttgcctttggggtctgcttaaagccatgtttgctagtagaaatcttgagtaaccagatatgttttataatgctgtgtcatatttaaattctgatgagattgacatctttaaataagcttggacacagattggatttgtacagggaactggactgaagaataatcgtagatcagtaatagatttagatatactatttttatattgtaagcagttacttctcaggattagtattctaattcatttgatttaatatgtaataggtaatattaaaaataaagattttatgctttgaaactccttaactgaatattttcataggaataagcatagtttttgtgtttagtaattttagttagtgagtaatgattagcagacaacatggtaattatattgaaatattacgtgagtgccaataacaaagctttctgatcaaatgctaagaaatatgttgtgtaaagggatctcacattttttattgcggctttctttctacaatgtgacaaatttctgggatatttcattatcttctttttgaatttttttcaagcaagactgttcagtattatgttagcattgatataaaaagaagcagaccattgttaacattaaaatgttactgagatttcaaa

SEQ ID NO: 67733 - DNA, 387 bp, Homo sapiens
attctggtgtggaatgagtgataaggtttctgactttcaacaaaatgtatctcctctgatatatgtgctaccttaacagaaagccaaagcacagaggcatattccaatagcaatttgcaagagacagtaggtttggaatggggtggtaaacttttactattttgcagggattttatctttcatttgatttatttttaatcatgaaatttatattgaaattctgtgaaacattgaaggatctttggaagatttataattagggaagggccagatgtagtggctaatgtctgtactcccagcactttgggagaccgaggcaggaggattgcttgaggccaggagtttgagaccagcctgggcaatatagcaaaactcattagtctgtta

SEQ ID NO: 67734 - DNA, 479 bp, Homo sapiens
  misc_feature (16)..(16): n is a, c, g, or t
  misc_feature (25)..(25): n is a, c, g, or t
ttttttaaaaaaaaanttaaaaatncttaccaaccaactacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67735 - DNA, 2033 bp, Homo sapiens
  misc_feature (6)..(6): n is a, c, g, or t
  misc_feature (626)..(626): n is a, c, g, or t
  misc_feature (662)..(662): n is a, c, g, or t
  misc_feature (1613)..(1613): n is a, c, g, or t
tttaantactaaatattacttataggaaaggaaaaacattattgaatatttatttaaatgtcacatctaatcaacttggtctgtttttgttctttttcttcttttaacctccaaaccatttcttaacccagtttcctctatctcaataaataaccccatcgtccactatccaaaaacctgcaggccatgttggattctgcttttccccttgttctttccttatccaatctaaataggaaattctggcagctctacctccaacgtatatcatattcatttatttctctccatctccactaaagctaactaaagctaaagtcactgaagctaacttgctttcaccctttttctggacattgtaattggcacctaaatggtatagcccctcaccttccttccaacctccaaacagcaggcatagaagctgtagtatatatgtgtgtatgtgtgtgtgtgtgtgtgtgtgtgtgtgtgtgtgtgtgtgtgtattgtttagacggaatcttgctctgtcgcccaggctggagtgcagtggcgcaatcttggctcactgcaagctctgcctcccgggttcatgccattctcctgcctcagcctcctgagtagctgggactacaggcacccgncaccacgcctggctaatttttttgtatttttagtanagacggggtttaccatgttagccaggatggtctcgatctcctgacctcgtgatccgtccacctcagcctcccaaagtgctgggattacaagcgtgagccaccacgcctgaccagtaatagtttttgaaatgtgaattagatcaagcttaaaccctttagtgggttccactagaaaaaaattacactttttttttttttgagatggagtctcactctgtcacccaggctgcagtgcagtggcccgatctcggctcaccgtaacctccacctcccgggttcaggcgattcttctgcctcacctctcaagtggctgggattacaggcacctgtcaccactcccggctaatatttttgtatttttagtggagacggggtttcaccatgttggccagggtagtgtagaactcctgacctcaagtgatccacctgcctcggcctcccaaagtgctgggattacaggtgtgagccaccgcgcccggccaaattacacttttgaaggcctgttttgccatccttatctcctctcaccttaccttctgtcaccagattctacccataagcagccctttggcatttttctgaacatgctgagatccttccttctttggggcttttgtgcttactgtttcttctaacttgaatgttctttgtcagtttttctgcggcgattcctctatattcacgtttcattgcaactattacctcttcagagaggccttttctaattttccttaatagtgtagtgccccccccaattattttgtattaaattactattttctttccttcatggtacttatcataatctgaaatttatttattatcatttattttttaaattcaataaatcatgacatcctctttccaatgagaatatgagccccatgaggaaagcaacctcaactgtcttcttcaccactgtacccctgcagtgccttgaacaatgcctgncacacagtagactgcatgaatctatgctgagcaaatggtgctaaggaatactaaagattgacaattgccaaattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaacc

SEQ ID NO: 67736 - DNA, 383 bp, Homo sapiens
  misc_feature (2)..(2): n is a, c, g, or t
cngggcagtacggatgtgcgggccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67737 - DNA, 834 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatggcatgatgtttgtgtaacatcttcactgaaaatcattgttttgaattttatttcattgtcttttctttttcttcttttctcccctctttgtctgttgttcatcttccggggaacatcaatgtcttctctactctatcgcatcttttttgtgtgtgttattcttccctcagtaaccctggcactgtgtaagtacttaaccaatgattcactttgtaattgtctctgtaactttccttcttgctttcaatttaatactaccagcaaattttgttaggattttctcattataa

SEQ ID NO: 67738 - DNA, 619 bp, Homo sapiens
  misc_feature (44)..(44): n is a, c, g, or t
agtccaactccatcctcaggtcgctctagagatccccgtctgancaagctgggacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccagctgctcagcggtaccgcgctcga

SEQ ID NO: 67739 - DNA, 787 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaaggtgtgtttttaagctagcacccagagtatcacttgattgtccttgctgagctactgtaattcccattactgtctcagaccatactgacattcatttaatttatagtctcagtacaattttccttgtagttcttttccttcagagatgagtagggaaatggagatcagcacataccattgtaattatacatgttataaaacattatttccaaagccatatgttacaataacttatgtcagatttcttacatttctattcacttttgatgagcccatctttatccaaatccttatattttctaaagagaataaataagtggttactgaaaattaat

SEQ ID NO: 67740 - DNA, 316 bp, Homo sapiens
cccgacaattgcagtataggggggggtatgcatagagatagagtaagggatacatggttagtatccactcagaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67741 - DNA, 490 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagttctggaggcaagtcccaaatcaaggtgctggcaggatcacattccctctaggagaatccttctttgcttcctccatctt

SEQ ID NO: 67742 - DNA, 722 bp, Homo sapiens
cggagtttcactgtgttagccaggatggtctcaatctcctgacctcatgatccgcccacctcagcctcccaaagtgctgggattacaggcgtgagccaccgtgccccgcctattttagatagatcttttaaaaacttgagaccgaatatacttgcaaagcaaactgtttatataaaaggaatattgaagattaatcatataaattataaataatttagtagaagatattttatccttttaatataactttacaatttttaattttttttttctccttaaccctagcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaagtaagttctctatctttttgacaattgaatgttttcctttcacgaatggtctcaatttagtttttcaaattgtcaagtataatggtatggcatttcgtctttgcagctagaagctaagcatttaactttggtgccttttgtgtgacctaaatgtacaacttgcagattttaaaagtagtagatattgtctggattttaaggcttgttttccctagtattgaaataag

SEQ ID NO: 67743 - DNA, 6102 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67744 - DNA, 6051 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaatgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67745 - DNA, 5733 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagaaaacacaagtgacaaataaccctggcactgtgaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67746 - DNA, 5775 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67747 - DNA, 6255 bp, Homo sapiens
caaattctttaagattattaattagagtttgcacattcctgagttaggtgaaaattatcttattccctgtgttttttgtttttttaaacttaaagagttagaaatgtgctgctccttctgcgtgaaacaaatgattccactctggagagaaatgaaacatgtttgaaaaatgggactatgggctttgaaagatggaaagatgggctttggatattttaacataaaaaacacctcagttagcaatgttttgtttattgtagggtatttaaacatttttcctttggaatatgcctaggttgacactgatgaggggctttaggctttctgatagttttcctgctgtatttccgaaatattttgaaactactttcatttttatttttaaaaattatacctaatgtgtgcatctgtgttatgcatgttgggactagttagcatgcacgttatgctttatcagcccattgtttttatctggaaacatgatgtttgagctgctaacctgattgtgtttgtcttttaaaaaatcagctctgtgttcttttcggtgaaatatattttgcatgtgtttggtgtggttttgtgtatgtttatttttgttttacatagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67748 - DNA, 5640 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67749 - DNA, 4882 bp, Homo sapiens
cctttcttgaaggaatcccttaagtgcacgtctcccgttttcttttcacatcaatgcagagtccctctgtgaatttacaacacccaacacccatgagttcagtccttaagaaggaaaattgagcaagtatttaattggttggacattgcataaaagaggtccatatccaggctaactctagaaattttattctcaaacttagttggcctctttttcttctgtcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67750 - DNA, 5032 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatactactgtcatcggggacctcagaacactaca

SEQ ID NO: 67751 - DNA, 2895 bp, Homo sapiens
ctcccttccacagcactaccccacctctgtgaataaaagctttcccaactttgtgatcacaattgaaaatgggtcacttattattgagagaaaaccaccaaaagtctcaaattcatcacatcctctgacccatcttttaatttttaaatgcagaagaagaaaccaaacggaaccaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67752 - DNA, 2099 bp, Homo sapiens
aaagatagaatcgagtcggtaccgaattccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67753 - DNA, 2341 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatgggaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaattgagaaatttaggggacctagatctattgggggattggtatctgtttttgttgtgattagggtagtaatctgggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaacttagctttgtacttgttctgtttccttgaggctagacacagtgccatccaggacttattacagtataactgggtaaaataaacaattctctgacaaaaaaaat

SEQ ID NO: 67754 - DNA, 2096 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaacc

SEQ ID NO: 67755 - DNA, 2014 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatgggaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaattgagaaatttaggggacctagatctattgggggattggtatctgtttttgttgtgattagggtagtaatctgggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaacttagctttgtacttgttctgtttccttgaggctagacacagtgccatccaggacttattacagtataactgggtaaaataaacaattctctgacaaaaaaaat

SEQ ID NO: 67756 - DNA, 1954 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagaaaacacaagtgacaaataaccctggcactgtgaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaattgagaaatttaggggacctagatctattgggggattggtatctgtttttgttgtgattagggtagtaatctgggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaacttagctttgtacttgttctgtttccttgaggctagacacagtgccatccaggacttattacagtataactgggtaaaataaacaattctctgacaaaaaaaat

SEQ ID NO: 67757 - DNA, 1959 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagaggaaccatcttgtgcacccaaagcctgagccggttcctgttcaaaagaaaacacaagtgacaaataaccctggcactgtgaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaattgagaaatttaggggacctagatctattgggggattggtatctgtttttgttgtgattagggtagtaatctgggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaacttagctttgtacttgttctgtttccttgaggctagacacagtgccatccaggacttattacagtataactgggtaaaataaacaattctctgacaaaaaaaat

SEQ ID NO: 67758 - DNA, 1939 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagaaaacacaagtgacaaagaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaattgagaaatttaggggacctagatctattgggggattggtatctgtttttgttgtgattagggtagtaatctgggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaacttagctttgtacttgttctgtttccttgaggctagacacagtgccatccaggacttattacagtataactgggtaaaataaacaattctctgacaaaaaaaat

SEQ ID NO: 67759 - DNA, 2097 bp, Homo sapiens
  misc_feature (1462)..(1462): n is a, c, g, or t
  misc_feature (1466)..(1467): n is a, c, g, or t
  misc_feature (1477)..(1477): n is a, c, g, or t
  misc_feature (1480)..(1480): n is a, c, g, or t
  misc_feature (1489)..(1489): n is a, c, g, or t
  misc_feature (1500)..(1500): n is a, c, g, or t
  misc_feature (1503)..(1503): n is a, c, g, or t
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatgggaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaattgagaaatttaggggacctagatctattgggggattggtatctgtttttggntggnngaataagggnagnataatcttntgggaaaaagngantttattttcccaataaggttgggaaatttggcgtatagtgggttgggtttgaaagccagaggatattatgttgagcaaaattaaaggctcccttggtcataatttggggaaaattacgtttcttttattatttattgaacattcttcccaaagattaactttgttaagaggttccatcttactatattggtacattccaagggtggatgtgtgtaaaatttattcttaaattaaggtaaattattagggagggcaaggaaattaacgcaaggaattttatttaataggaagaggtgtgtgcttgggaaaagattaagggtactcctttaaaagggagggtacaattccagggagtggctctatgacagaagggaggggagggcccaagattgcgcctcggaacaagggacaagaagagcaattataacccctatgtgtcatggggaacaatacaggaatcctgggtggggggttgggccaaatcctatttcctatacaggaaatattctgcggattttctagacacttttgacattctggtttacttatagaattggacagaaactctggttttatcgacagaacttaatactc

SEQ ID NO: 67760 - DNA, 491 bp, Homo sapiens
gaaaccctggctcacatctcgggtctataactagagcaccctgtgctggctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67761 - DNA, 1904 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgactatatgccatggatgtgaatttcccatagaagctggtgacatgttcctggaagctctgggctacacctggcatgacacttgctttgtatgctcaggggcttgtccttcttggagaaaaaggtctgaccttccaaactttcacaacacacgtcgac

SEQ ID NO: 67762 - DNA, 1364 bp, Homo sapiens
  misc_feature (1072)..(1072): n is a, c, g, or t
  misc_feature (1101)..(1101): n is a, c, g, or t
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagaaaacacaagtgacaaagaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaattgagaaatttaggggacctagatctatggggggattggaatcggcgggggggataaaggggtangtactttgggagaaaccagatttattttncataaacgcgtgacattgggcgttcaagtgggtgggttagagcaagacggatattggcaattaaagacctgggtaaatgggagaaatatttctttctatatttacatttccaggaatacttttaggtctattactgtcactccacagttgcttggaatttttcactaggttaattgggagcaatacaagagttataaaaaaagggtggggaagctagctattaagaggcaaaggagtatgaaaaggaggcaattgttgaagaa

SEQ ID NO: 67763 - DNA, 2245 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggatagagacggggtttcaccgtgttagccaggatggtctcgatctcctgaactcgtgatccgcccgcctcggcctcccaaagtgctgggattacaggaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttatta

SEQ ID NO: 67764 - DNA, 1496 bp, Homo sapiens
gctcgtgtgttgtcttgcagtcactttattttgaacataaaaatgtatgtttccaagagggatctgtggattaattgctatatttctaaaaatgctctacccttaaaatttttgccacttaataaaacagctatgtgaaattaagcttttataaggcatgttttctgcatgatggaattagtctagaacctttttccttctatttcttatgactcttctatcactctttttttttttttttttgtatttccacagggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaattgagaaatttaggggacctagatctattgggggattggtatctgtttttgttgtgattagggtagtaatctgggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaacttagctttgtacttgttctgtttccttgaggctagacacagtgccatccaggacttattacagtataactgggtaaaataaacaattctctgacaaaaaaaat

SEQ ID NO: 67765 - DNA, 1322 bp, Homo sapiens
  misc_feature (1272)..(1272): n is a, c, g, or t
  misc_feature (1286)..(1286): n is a, c, g, or t
  misc_feature (1302)..(1302): n is a, c, g, or t
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgggttgtccactcctgtntggatgacatcgtntacagtgaagccagantgggtttccttgtcccgaag

SEQ ID NO: 67766 - DNA, 1384 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatgggtaggtggctaaggtgctttctgctcttactaaaactcttctttcaggtaatttccaggaaatactctacattcctctcccccaaaaccaactttctttgaaggaagggagatgaagtattatttgcctcattaacatatggcctttatatacatagggtactttctgcaaagcaattatcacttattcaaaagctacttgtgcattttgacatgttctgaaccatgtaacatctctgtaactcattttttgtaagtcccgacacagcattgagcagctggcacttgtaatgcaaggcaaatcttgaatctttcttccttcaaagaaagttggttttgggggagaggaatgtagagtatttcctggaaattacctgaaagaagagttttagtaagagcagaaagcaccttagccacctacccattttgctgtttactgtcaccctgggatcctcttctctgtccctctgctagctcctgagaagtctcggaacacacgctggtgactgtggg

SEQ ID NO: 67767 - DNA, 1530 bp, Homo sapiens
gcgcccactccgcggcgtcggggaaatggctgcgagaccctagaggcctgggagcttactccacgggaacagcctctagataatctgagttgtgaaaatacgaagccgtgttactcgtgaacagtggctgacaacagtgttgtgtgagcctggctgtctgcttggacccagaggtttcgtctgccagggtttggcgtgtatcaggattctcagggaaacagtgtccaagctttcagtgttggagcaggtatggacgacaaaggcgacccgataatacaaagaaggcaacggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaattgagaaatttaggggacctagatctattgggggattggtatctgtttttgttgtgattagggtagtaatctgggaaaacgaattattttcataagttgaatttggttagttggttggttgaagcagaggataatgagcaaataaagtccttgtctaatttggaaaatactttctttatattattaacatctcccaagattactttttaagttcattattatgttacattcaaagttgattgtaaattattctaaataagtaaatataaggaggcaagaataaacaaagactttattaaagaagagtgcgtgcattgtagatttaggtatcttttaaagtaggtactattcaggatggctctatgaagaggaggaggtccagatttggctcctgaaaaaggaaagaagagaattttacccctatttgcaatggagaaatacagtattctttggtttggttggatttgcaaatcctatttcctatcaaaggaaatatctctagtggatatttttagaatatagacaatttctaggtattaactaataagatatggaaaagatagctttgctttttttaatcagaagaacataaaataaattacaatatgaatgattgtgagacatcagagaaatattttacttagtgacgtaaactactgtgcactgctgctattcctaggaagctgtgttttgggcaatacatggaagctaaatatatgaccagaaatgctttctgccttgtaatatagtgtattatatattagagctaaatttagtaataaatgcattttgaagtttggaaaagtattgtaataaagttgcctttaacttagctttgtacttgttctgtttccttgaggctagacacagtgccatccaggacttattacagtataactgggtaaaataaacaattctctgacaaaaaaaat

SEQ ID NO: 67768 - DNA, 1537 bp, Homo sapiens
caaattctttaagattattaattagagtttgcacattcctgagttaggtgaaaattatcttattccctgtgttttttgtttttttaaacttaaagagttagaaatgtgctgctccttctgcgtgaaacaaatgattccactctggagagaaatgaaacatgtttgaaaaatgggactatgggctttgaaagatggaaagatgggctttggatattttaacataaaaaacacctcagttagcaatgttttgtttattgtagggtatttaaacatttttcctttggaatatgcctaggttgacactgatgaggggctttaggctttctgatagttttcctgctgtatttccgaaatattttgaaactactttcatttttatttttaaaaattatacctaatgtgtgcatctgtgttatgcatgttgggactagttagcatgcacgttatgctttatcagcccattgtttttatctggaaacatgatgtttgagctgctaacctgattgtgtttgtcttttaaaaaatcagctctgtgttcttttcggtgaaatatattttgcatgtgtttggtgtggttttgtgtatgtttatttttgttttacatagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatgggtaggtggctaaggtgctttctgctcttactaaaactcttctttcaggtaatttccaggaaatactctacattcctctcccccaaaaccaactttctttgaaggaagggagatgaagtattatttgcctcattaacatatggcctttatatacatagggtactttctgcaaagcaattatcacttattcaaaagctacttgtgcattttgacatgttctgaaccatgtaacatctctgtaactcattttttgtaagtcccgacacagcattgagcagctggcacttgtaatgcaaggcaaatcttgaatctttcttccttcaaagaaagttggttttgggggagaggaatgtagagtatttcctggaaattacctgaaagaagagttttagtaagagcagaaagcaccttagccacctacccattttgctgtttactgtcaccctgggatcctcttctctgtccctctgctagctcctgagaagtctcggaacacacgctggtgactgtggg

SEQ ID NO: 67769 - DNA, 176 bp, Homo sapiens
tgaaccatgtaacatctctgtaactcattttttgtaagtcccgacacagcattgagcagctggcacttgtaatgcaaggcaaatcttgaatctttcttcctcaattttttcattcttttaaataggccaccaaaagttcaaacagtggttacagttgctgtcaccttacacaactc

SEQ ID NO: 67770 - DNA, 952 bp, Homo sapiens
  misc_feature (829)..(829): n is a, c, g, or t
  misc_feature (835)..(835): n is a, c, g, or t
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagaaaacacaagtgacaaataaccctggcactgtgaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagctggcccaagggcngatacnttcataatttttttcactcctaggactcgttatgttttgaaaaacttctttttaactctttggggaggagacatctgtttggggcttgcaaaaaatgggcttgtgttttgtggttca

SEQ ID NO: 67771 - DNA, 580 bp, Homo sapiens
acagttcaagcaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgtttatattatgcctgttgttcctttcctctccaccctgactcacaaaacatttgctccacaaggacaggagtctgttttgttattgtctatatgtctaaaatggtgtcaggcccataggaggcatccaaacttgtattgaaggaaagaatggaaataataggaaaatctccctcatatggttacagtgaagctcccgtgaactgataaacctaaagtgccggcacagaggaagtaccaaaatataagcctacgatgc

SEQ ID NO: 67772 - DNA, 5967 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67773 - DNA, 5793 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatgggaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67774 - DNA, 5683 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67775 - DNA, 5556 bp, Homo sapiens
ccacgcgtcgcggacgcgtggctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagcccacagtcaccagcgtgtgttccgagacttctcaggagctagcagagggacagagaagaggatcccagggtgacagtaaacagcaaaatgggaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67776 - DNA, 6048 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagtttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67777 - DNA, 4486 bp, Homo sapiens
  misc_feature (12)..(12): n is a, c, g, or t
  misc_feature (15)..(15): n is a, c, g, or t
  misc_feature (35)..(36): n is a, c, g, or t
gcacgagaagtnacncaaacacttctgctttcacnnttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttaattcaccagcagtaatcctttaataactggcagagcactttattcttctggtgagctccctgaatatttatttttctgattataaattttctatattagtagcattttttaattattacttcttcactatagagcatttacttttagtctctagatgtatattttggaatgctgtacttggcataacatagattaaaatcataatgcatgactaaaaactccttggatttatttcccattttaaaatttttagcggtaagttcagatttataatctttctctagacttccatggtctgaatgttgcctgctgaagtagcaacctaaaaagtatcccctgcttatgcttctccagttggccctccatgtccataggcttcgcatctgtgattcagcccactgtgggtcaaaaatatttggggaaaaaaatggatggttgcgcctttgctgaacatgtacaaacttttttttgtcattaaacaatatagtataacaactatttacaaagcatttacattgtattagctattataggtaatctagagatgatttaaagtgtatggtaggatgtgcacaggttatatgcaaatactacaccattttctataagggacttgaacatcatggactttagtatcctagggggttcttggaacccatcacccataggggcaccataggacaactatagtaccgtgtttatttcctattaattcaggttccgtttagagtctaaaactaaaacctaatcatttagtcacagtgtaaaaacaaatggaaataacagctcaaatcttcaaaatattactatagcattatgtttaaaataatctacaacaaaaatgtaccattttcaagcagtactacattaggagcccttttatagaaaataatttcttctttacccccgttccagtgtgaatctagtattctgttaacatttgtgtggcatttggagtttgtcatccccattgaagggagagccttctcagacatgaagcaagggaaacatactgaatagttttacacaaatttgatctggcttccatttgtccccctcatttcccaaatgtttaaatgtattggatttggattctcaatgtataagttgccttatctgttaatgtctatcttctgtctctttaattttgtatatctgctgttttgcttttggatacattttctaattagaagtcacatgataaatataatcagtatagtaataataccataatgtgcacatactcaataaataaatgactgcattgttgta

SEQ ID NO: 67778 - DNA, 4868 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttattattactttttcctgtattttatgcccataaaataagctttataaaaaccaatttcctgatggactattaaattcatcttagaataaattagtgaagaatttaattttagaataaataatccaatctgaaataattataccttctttccttgttaggtagttatgagtaaatctgcaaaaggcaatgaaaatgccttaaattttatcaataacagaattattgtatttaaaaaaaaactaatacttatctttaaaatagtaaataggattttaaacagagaattttatcagtaataggtgtcagtttttaaaaaattgcttgtaggctgagcgcggtggctcacgcctgtaatcccagcactttgggaggccaaggtgggtggaccacatgaggtcaggagtttgagatcagcctggccaacatggtgaaaccccatctctactaaaaatacaaaaattagccggacgcagtggcacgcgcctgtaatcccagctactcaagaggctgaggcacgagaatcacttgaacccgggagggagaggttgcagtgagccaagatcgtaccactgcactccagcctgggtgacagagtgagactccgtctccaaaaaaaaactttgcttgtatattatttttgccttacagtggatcattctagtaggaaaggacaataagattttttatcaaaatgtgtcatgccagtaagagatgttatattcttttctcatttcttccccacccaaaaataagctaccatatagcttataagtctcaaatttttgccttttactaaaatgtgattgtttctgttcattgtgtatgcttcatcacctatattaggcaaattccattttttcccttgcgctaaggtaaagatttaattaaataattttggcctctcatagttttctctctctttaaagagaataaatagagggccaggtgtggtggctcacgcctgtgatcccagcactttgggaggccaagacgggcggatcatgaggtcaagagatcaagatcatcctggccaacatggtgaaaccctgtctctactaaaaatacaaaaatgagctgggcatggtggggcgtgcctgtagtcccatgtacttgggaggctgaggcaggaaaattcttgaacccaggagacggaagttgcagtgagctgagatcacaccactgcactccagcctggtgacagagcaagactccggctcttaaaaaaaaaaaaaaaaaaaaaaaaagagagagagagaataaatagaaaagaatgtggctgggaattgtgaatcagaagattataccccccaattgtttttcaatccccttttctcaaataataaattagttaaatcagtttctgagttatgccactggctgatgaagagttgagaggtctctttgcagaatgatctttttgtttcgttttgtttcttcttctgcatttaaaaattaaaagattggtttgaggatgtgatgaaattgagactttttgtggttttctctcaataataagtgaaccaatttcaaatgtgatcacaaagtttggaaagcttttattcacagaggttgggtagtgttgggaggggagtttaattactcagattggcctgttatttgatttcctcctttgggaaaagaattatgtagataccacatggagacagggaaacaattgtggtaaaactgtggatcctgttgctatttgcccagtgagaaaacagattctggtatttgatttggtttttctctttgtttccagaatggatgaaagtccatgaacctcctaagttataatttaaatttgtttggggcaaggtgattttatagtcgagacagagccctaggtccttcctgccccatcactcacttacgacatcacttccattgtgtgcatgtttgttatagaggaggttttaggctacaatatttgtttaacctccctaagaactttcaaggcatctgtcctgaaagctgttaatttatggtctagcagatttatattatatgcagataataattaactggggataaaagaatggcaaggggtgacacaaagtagcaaactgaatacttctccaatagcaaccccaagctacctcctcaccctgcatcttggagggaggcaggaaatttcttttgaaataaagtgctggagctgaattctgcattatttatcgttgctgctgaaaccacctataaaagacttgctggctaatgtgcattgtcatataatgtacactgtcacatctttacagtcttgtatgttatagaatacaaaataagttgatggttttgtttggtgtgagctttttgtttgtttagttttgccttcataggttatatgccaagatagtatttgataagtcaatgacatttggatgttttcttcaaagaattttatttgacccagatttcttataaagttatcttacattaaggatgtcattttcatcagaccttctttctacatattattcatgaagcataatgttgcatttctccaaattttatgcctgaaagggtagtgttgcttcctaaggtatcatgttgtctttgtgctttgtccatctcttccgtggcgaagctttatatctgttcctaaaacagttaatcctgtgaaataaatattgaacataatccagaagaatctctctgtttcccttggggaatgccatatttattctacctagctagctagctagctcggaggagtttgcg

SEQ ID NO: 67779 - DNA, 2151 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaataactctcaggagccttctccgcagttggcttcctcggtagcttccacacggagcatgcccgagagcctggacagcccaacctctggcagaccaggggttaccagcctcacaactgcagctgccttcaagcctgtaggatccactggcgtcatcaagtcaccaagctggcaacggccaaaccaaggagtaccttccactggaagaatctcaaacagcgctacttactcaggatcagtggcaccagccaactcagctttgggacaaacccagccaagtgaccaggacactttagtgcaaagagctgagcacattccagcagggaaacgaactccgatgtgcgcccattgtaaccaggtcatcagaggaccattcttagtggcactggggaaatcttggcacccagaagaattcaactgcgctcactgcaaaaatacaatggcctacattggatttgtagaggagaaaggagccctgtattgtgagctgtgctatgagaaattctttgcccctgaatgtggtcgatgccaaaggaagatccttggagaagtcatcaatgcgttgaaacaaacttggcatgtttcctgttttgtgtgtgtagcctgtggaaagcccattcggaacaatgtttttcacttggaggatggtgaaccctactgtgagactgattattatgccctctttggtactatatgccatggatgtgaatttcccatagaagctggtgacatgttcctggaagctctgggctacacctggcatgacacttgctttgtatgctcagtgtgttgtgaaagtttggaaggtcagacctttttctccaagaaggacaagcccctgtgtaagaaacatgctcattctgtgaatttttgaaagtcaacagttcaggagaagagaaggaatttgaagagaaaaaggaaaattaaaattactaattaatttttagattcaatatttatatggagttttgaaaaataatagtggccctgaaggaataaattccagctttaaaaaccaagtctgaggaaatatttggcttcataaagtaaagagacggtttggcatttatta

SEQ ID NO: 67780 - DNA, 1766 bp, Homo sapiens
  misc_feature (1474)..(1474): n is a, c, g, or t
  misc_feature (1503)..(1503): n is a, c, g, or t
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatgggaaaatcccacctaaacgcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaggaaaagataccccttcacgtctttagtcccaaatacacaaaattacgtgactggcaccatgaagtttcagcacgtgctcttaacgtacagtgatttatgagccttgccccccaagcagccagcacataccttttcatttactttttttttttcaacttcatagcaaaatctgtattaaatttgccttatgaaaaaatagaactttttctatacttttctaacaatttcctattgttgtgagaaaaggaagatgaacatgttttgtgctagttggtagctcacaaatgtaaaaccaaaaaaaaaaaaaattgagaaatttaggggacctagatctatggggggattggaatcggcgggggggataaaggggtangtactttgggagaaaccagatttattttncataaacgcgtgacattgggcgttcaagtgggtgggttagagcaagacggatattggcaattaaagacctgggtaaatgggagaaatatttctttctatatttacatttccaggaatacttttaggtctattactgtcactccacagttgcttggaatttttcactaggttaattgggagcaatacaagagttataaaaaaagggtggggaagctagctattaagaggcaaaggagtatgaaaaggaggcaattgttgaagaa

SEQ ID NO: 67781 - DNA, 1187 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagagcatctgctgcacccaagcctgagccggttcctgttcaaaagggagaacctaaagaagtagttaaacctgtgcccattacatctcctgctgtgtccaaagtcacttccacaaacaacatggcctacaataaggcaccacggccttttggttctgtgtcttcaccaaaagtcacatccatcccatcaccatcgtctgccttcaccccagcccatgcgaccacctcatcacatgcttccccttcacccgtggctgccgtcactcctcccctgttcgctgcatctggactgcatgctaatgccaatcttagtgctgaccagtctccatctgcactgagcgctggtaaaactgcagttaatgtcccacggcagcccacagtcaccagcgtgtgttccgagacttctcaggagctagcagagggacagagaagaggatcccagggtgacagtaaacagcaaaatggcccaccaagaaaacacattgtggagcgctatacagagttttatcatgtacccactcacagtgatgccagcaagaagagactgattgaggatactgaagactggcgtccaaggactggaacaactcagtctcgctctttccgaatccttgcccagatcactgggactgaacatttgaaagaatctgaagccgataatacaaagaaggcaaaagcatctgctgcacccaagcctgagccggttcctgttcaaaagggagaacctaaagaagtagttaaacctgtgcccattacatctcctgctgttgtctgctgcag

SEQ ID NO: 67782 - DNA, 605 bp, Homo sapiens
gggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaacatgcctctgacaatctctagtctaaaagatggcggcaaggcagcccaggcaaatgtaagaataggcgatgtggttctcagcattgatggaataaatgcacaaggaatgactcatcttgaagcccagaataagattaagggttgtacaggctctttgaatatgactctgcaaagcagttactcgggagttacccagctactcaggaggctgaggcaggagaatcgcttgaacccaggaggtggaggttgcagtgagctgagatcgcgcctgggtgacagaacaagactccgtctcaagaaaaaaaaatgcttatgttctgtataaaatcttcaataaaatgacgataccagtacctcatatttgtataa

SEQ ID NO: 67783 - DNA, 954 bp, Homo sapiens
agcagaagagactgtcagcagaccaccttggaggggatgcttggagctgcctaacgtgtgattcaaagatgaattccatgtgtttggagaagaagccctagcctcaacacaaaggttggccacattccagccaaggtagcacggagtgaaggcccgtggagggagagctgggcttttctgaactacttcagtacaccttgctgtgccttggcctgccgtgtttcatccccatggctgtcctcagtgatgtgcatggtcactgctcccttcaccactgagaagacgggcacaggacagtcaggggatgtgtccaaggtcccacagcaggaagggctggagccagaatgtggtctgagaggctggatatacaaagagacaatggcatgaccatctgtacaaatggaactatggcccacaacctgcagcagccagcccaggaagccaacccgtcacctgcagcagccaggatggatgctggcctgccctcagttgtactcacatcattggtcttatggggaaattttaagacctcccacttgtaaggttttatagccctctatggaatattgaagaaagagtaaaatgcatccaaaaaaaaaaaaaaacactaaactggataaattctaaggcctcttcaggtcttaagatggccattttctaggtcctcttgctgcagcagtgaaatccacaaacacggacaagtcagtcagttacgtgcctttcagagaaaacttctgacttaggaattccagctatttggcccaacccatattagattgtgttacttaaagccatggtaaattcacatcccgaagggaagagcagaggaaacataatattccttcaagacccatcagctcagatgttagcagaacacccctaaggaggaaaacaagaaattttgggtttgaacttggtacttcccagcagccctgggagtggggtcagaagccc

SEQ ID NO: 67784 - DNA, 1188 bp, Homo sapiens
agcagaagagactgtcagcagaccaccttggaggggatgcttggagctgcctaacgtgtgattcaaagatgaattccatgtgtttggagaagaagccctagcctcaacacaaaggttggccacattccagccaaggtagcacggagtgaaggcccgtggagggagagctgggcttttctgaactacttcagtacaccttgctgtgccttggcctgccgtgtttcatccccatggctgtcctcagtgatgtgcatggtcactgctcccttcaccactgagaagacgggcacaggacagtcaggggatgtgtccaaggtcccacagcaggaagggctggagccagaatgtggtctgagaggctggatatacaaagagacaatggcatgaccatctgtacaaatggaactatggcccacaacctgcagcagccagcccaggaagccaacccgtcacctgcagcagccaggatggatgctggcctgccctcaggtgcccttgttggagaacatgggggccaaattccaaacgtggcaagagataacaaatgacttgtctggtggctgaaccctgagctgggagcactgcctggagaaaactctgatactcaagtctagttttatatggctccaaacgcctccaccatgagctcaaggcagtgagactgactgaaaaaccctctctattacagaccacaacattgaacccaacatccccctaagtaggttgtactcacatcattggtcttatggggaaattttaagacctcccacttgtaaggttttatagccctctatggaatattgaagaaagagtaaaatgcatccaaaaaaaaaaaaaaacactaaactggataaattctaaggcctcttcaggtcttaagatggccattttctaggtcctcttgctgcagcagtgaaatccacaaacacggacaagtcagtcagttacgtgcctttcagagaaaacttctgacttaggaattccagctatttggcccaacccatattagattgtgttacttaaagccatggtaaattcacatcccgaagggaagagcagaggaaacataatattccttcaagacccatcagctcagatgttagcagaacacccctaaggaggaaaacaagaaattttgggtttgaacttggtacttcccagcagccctgggagtggggtcagaagccc

SEQ ID NO: 67785 - DNA, 521 bp, Homo sapiens
tttggatgctggcctgccctcaaccacaacattgaacccaacatcccctaagtaggttgtactcacatcattggtcttatggggaaattttaagacctcccacttgtaaggttttatagccctctatggaatattgaagaaagagtaaaatgcatccaaaaaaaaaaaaaaacactaaactggataaattctaaggcctcttcaggtcttaagatggccattttctaggtcctcttgctgcagcagtgaaatccacaaacacggacaagtcagtcagttacgtgcctttcagagaaaacttctgacttaggaattccagctatttggcccaacccatattagattgtgttacttaaagccatggtaaattcacatcccgaagggaagagcagaggaaacataatattccttcaagacccatcagctcagatgttagcagaacacccctaaggaggaaaacaagaaattttgggtttgaacttggtacttcccagcagccctgggagtggggtcagaagccc

SEQ ID NO: 67786 - DNA, 1079 bp, Homo sapiens
agcagaagagactgtcagcagaccaccttggaggggatgcttggagctgcctaacgtgtgattcaaagatgaattccatgtgtttggagaagaagccctagcctcaacacaaaggttggccacattccagccaaggtagcacggagtgaaggcccgtggagggagagctgggcttttctgaactacttcagtacaccttgctgtgccttggcctgccgtgtttcatccccatggctgtcctcagtgatgtgcatggtcactgctcccttcaccactgagaagacgggcacaggacagtcaggggatgtgtccaaggtcccacagcaggaagggctggagccagaatgtggtctgagaggctggatatacaaagagacaatggcatgaccatctgtacaaatggaactatggcccacaacctgcagcagccagcccaggaagccaacccgtcacctgcagcagccaggatggatgctggcctgccctcactgatactcaagtctagttttatatggctccaaacgcctccaccatgagctcaaggcagtgagactgactgaaaaaccctctctattacagaccacaacattgaacccaacatccccctaagtaggttgtactcacatcattggtcttatggggaaattttaagacctcccacttgtaaggttttatagccctctatggaatattgaagaaagagtaaaatgcatccaaaaaaaaaaaaaaacactaaactggataaattctaaggcctcttcaggtcttaagatggccattttctaggtcctcttgctgcagcagtgaaatccacaaacacggacaagtcagtcagttacgtgcctttcagagaaaacttctgacttaggaattccagctatttggcccaacccatattagattgtgttacttaaagccatggtaaattcacatcccgaagggaagagcagaggaaacataatattccttcaagacccatcagctcagatgttagcagaacacccctaaggaggaaaacaagaaattttgggtttgaacttggtacttcccagcagccctgggagtggggtcagaagccc

SEQ ID NO: 67787 - DNA, 723 bp, Homo sapiens
agcagaagagactgtcagcagaccaccttggaggggatgcttggagctgcctaacgtgtgattcaaagatgaattccatgtgtttggagaagaagccctagcctcaacacaaaggttggccacattccagccaaggtagcacggagtgaaggcccgtggagggagagctgggcttttctgaactacttcagtacaccttgctgtgccttggcctgccgtgtttcatccccatggctgtcctcagtgatgtgcatggtcactgctcccttcaccactgagaagacgggcacaggacagtcaggggatgtgtccaaggtcccacagcaggaagggctggagccagaatgtggtctgagaggctggatatacaaagagacaatggcatgaccatctgtacaaatggaactatggcccacaacctgcagcagccagcccaggaagccaacccgtcacctgcagcagccaggatggatgctggcctgccctcatgtgggctccaccaccctcctgcctgctgtgggaaatcaggagggtgaaggtgaagctggacttggcccagaggtgcccacagggacgcccagagctgcacaagctccctccatcttgcctctgggaccagctctgcattgctccaaagccctcatcagtgtctgctttctgttgcaataactgaatacctgagattggacaatttataaagaaaaaaattatatctgacaattc

SEQ ID NO: 67788 - DNA, 751 bp, Homo sapiens
agcagaagagactgtcagcagaccaccttggaggggatgcttggagctgcctaacgtgtgattcaaagatgaattccatgtgtttggagaagaagccctagcctcaacacaaaggttggccacattccagccaaggtagcacggagtgaaggcccgtggagggagagctgggcttttctgaactacttcagtacaccttgctgtgccttggcctgccgtgtttcatccccatggctgtcctcagtgatgtgcatggtcactgctcccttcaccactgagaagacgggcacaggacagtcaggggatgtgtccaaggtcccacagcaggaagggctggagccagaatgtggtctgagaggctggatatacaaagagacaatggcatgaccatctgtacaaatggaactatggcccacaacctgcagcagccagcccaggaagccaacccgtcacctgcagcagccaggatggatgctggcctgccctcagagtctgagagactctcctgccccacagtgtgggctccaccaccctcctgcctgctgtgggaaatcaggagggtgaaggtgaagctggacttggcccagaggtgcccacagggacgcccagagctgcacaagctccctccatcttgcctctgggaccagctctgcattgctccaaagccctcatcagtgtctgctttctgttgcaataactgaatacctgagattggacaatttataaagaaaaaaattatatctgacaattc

SEQ ID NO: 67789 - DNA, 1838 bp, Homo sapiens
  misc_feature (274)..(274): n is a, c, g, or t
  misc_feature (326)..(326): n is a, c, g, or t
  misc_feature (1032)..(1032): n is a, c, g, or t
  misc_feature (1612)..(1612): n is a, c, g, or t
  misc_feature (1709)..(1709): n is a, c, g, or t
  misc_feature (1780)..(1780): n is a, c, g, or t
  misc_feature (1824)..(1824): n is a, c, g, or t
atacaaaaattattacacagctatcagagcaagagggaggttagtaaaagctggtggaccttaaagtttctctacttttgcaagtgtaaaaactggggtaaagatagagtttgggataacggacacagccatagccaaagaatgagtctagtgtctatagagaagttgtgatatttggaattttccatgtgcaaacacacacgcacatgcacgcgcacacgcacacacaccacacactcctcacctttgccattttcatagggaaacatgaagnaacaagtatatggattttggaattgggcagtgttttatttcagccccatgtncgcttgctagctatgtgatatgtgactttgggcaacttgtttatcttttctgggaaaacatatacctctaggggtgcagtaagggataactgggaacagtggagtgtgtgcctggtacaaagcctgcggtgtagatgccatttaataaatgatggttttctctatcctgcatcttgagagtagatccaatctattgtttattctttacagtaggcatggtagagtaaaaggaacaaaggaatcgagggaggaagggaagaaaaaatgagaaaaaccataaggccaggcgcggtagctcacgccagtaatcctaatactttgggaagctgaggcgggtgggcggaccacgaagtcaggagttcgagaccagcctgaccaatatggcaaaaccccatctctactaaaaatacaaaaaaaaaaaaaaaaaaaaaaaagttagccgggtatggtggcacgtgcctgtaatcccagcttctggggaggctgaagcaggagaattgcttgaaaccgggaggtggaggttgcagtgagccgggatcacaccactgcactccagcctgggtgacagagtgagactccctctcaaaaaaaaaaaaaaaaaaaaaaaaaaaaaaagaaaaaggaaaaagaaaaaaaagcaaccatgagacgagcaagaagctaagtttacaaataaatgtgatccacacttctcaacatcaggacnggtccttcatgcttagattccaggtctcttcttgcgaatgggaacagtcatcacttatccaatgatgcatttaagagcaccaagttttaaaaagagacaaatgtcgaaaagaaatgccatttatcatcaaacaccattattaaacactagcttgttggcatatctgtaagtctggttgtcattttgctaggtggagagggcagaattttggaaagtatctaggccacacccatgtttcagaatagtaagtacaaaagccacaatgtattgatcacttagactcatcatatgtttgtccttttattttaaataccccaaggatggaggtctttctagcctaattttccagctaagaaaatcaaggataaaaaattttcttgtgttgttactttatccttagtacccccctgggaagtaggtataattagcctcatcttagagatgagaaaactgaggctcagagaggactgtcctgtaaccagaaagaggatgtgttaggatctgaacccatctgacgaaaggctatgctcttaattagtaacatttccctgccttgcaaggacacatgtaggtcacaggntacccagggaaggtaaatgctctgtccttttctcaccagtactacaacttagtaacagcctctggcccaaaatgagactggacattgactttaatgnatggaagtacacattcctaacatggattcattcagaagcacccagatttcacaagaggaaatgatgaggcntttttctgaggtgttgaaattgtgccctttgtcagtcacaaacnaaccaaaaaaaaaa

SEQ ID NO: 67790 - DNA, 432 bp, Homo sapiens
gcaaagcaggagcaaagccccttataaaaccatcagatcgtgtcagaactcactatcatgaaaacagcatggaggtaactacccccatgattcaattacctcccccacccggctccctcccatgacacgtggagattatgggaagtacaagatgagatttgggtggggtcacagccaagccatatcagcatgtgcggcaaagccaggctgggcgggcttgtctgaggtccctccatggcatacgcaggcattttctgtggtagctggggagggggcagtccccaggcctccggtggaatgcttgggtgggaggtaacagcagttgtgctgtgaccttgccactggggagggtgaggctgctttcagtggcagcagcccatgccagtgagtgggaacacgcaccccacttgcaccttggcagtggcagcccgc

SEQ ID NO: 67791 - DNA, 346 bp, Homo sapiens
gttatagctaacactgtgtacttcacactactgctatttattatttttctttttctatatagattactggcaacatttctagtttatcttttgtataaaagcagaaaaatagaacacctggctgtttcttctcacctcatagagtaatgatattttactttatcttttatttactctgatatatttaatacaatttttcatttcgcagtcttttgcagtagcttctcttttctcctttcaggtttcaaatcgtccttctttaagcccttgttttgtccttatttcttctgcagttatttagttacttgtctctctatccatgtcctatggcttggctattcgagtt

SEQ ID NO: 67792 - DNA, 673 bp, Homo sapiens
ttatttctcttttaccagttccttcctgaaatttccatcctggaatgaatttgttttatataagaaattgatttttgttgtttctctgcatttatgaatatgtcatcatacttgtgagagagacaagaaaagtaaaaaaattcagagtgcagagtgattaaaatataaagttgatatttgtatacacttttctatctctttctggttttatatttgcaacatcagtgcctatttgaccaagaaaacaaagatctagaaattcttgggggttcaagacttctgccttcttgagaggcagagagggattggaatgaatagctcacctcgtcacttggctgcagctgctcaatggaaattgccatagttcactattgggcaaagttagagctgcagttcccgaccctattggcctcaggtgccagtgggtccagtttcagggaagttggcagggaaacagatgagaaggaagttggaagagagacacaggcagtgtagtacattctgacttttctaaatctagacctgttagctggatagtatgtcctgctctttgattataaccctgagctagaaagaggaaacacatttatcttgtacctaaaagctgatcccacatgaagaaccaagtcatggaaagaaaactaagcgaggattttaagtgagatttgttatc

SEQ ID NO: 67793 - DNA, 963 bp, Homo sapiens
gcttagaaaactccagcaactgaagcacagactggtaactgagtagctacagggaattaatgcttctctttaagcacctaatttcatatctggaaatggcaaacagggatgaaaatcgattatgttttggagactccttttggacatgtatcagtgtgttgatttgcacaaaccaataaaagccctacattttttggaaatggatccctagatttcaagcatgtataatcactcaaagtggatatgatcacaggcattcttctcttgagctcagcaaaactatgcctaccaacaccgaagagaagtcaaagatttaaatgaaaaaaaattgcagatgatgttggtgagataataggatatgagcaatgaacccttgggtggggttccagggcacttaaattgcctcgtgtcttgagttccttaagatggactcaaacaaaaaattagtattatcaataacaggtaatactgtgtggattctaacaacattagaatcattagctggcaagtgtcaactctgaacaagatttgtcagcttatcataattccaaccagttaattgatattgttcgaatttatctcattttttctcaaaggaagtgctctattagggatcaaaaagtctcacctggttcttaaaacctaacacaatttgaccttgaatcctcgacactaaaaattacgttggttgggtatcagattgaaaatatgcatggaggctgggcgtggtggctcacacctgcaatcccagcactttgggaggccaaggcaggcagatcacctgaggtcaggagttcaagaccagcctggccaacatggcaaaaccccgtctctactaaaaatacaaaaactagccgggcatggtggtgtgtgcctgtaatcccagctactcgggaggctgaggtgggagaatcacttgaacctgggaagcagaggttgcagtgagccaagttcgcgccattg

SEQ ID NO: 67794 - DNA, 277 bp, Homo sapiens
cacagtataacaactatttacacaatatttacattgaattaggcattaaaagtaatctagagatgatttaaagtaattgggatgatgtgcataggttaaatccaagtactgcatcattttataaaagcgacatgaacatctgcagatgctggtgtccacaggggttgtggaaccaatctcctgcagataccaggacatgactgtacatttatcctacttacatgtaaataaagtaaaatagggttattaaaagacttccaacaacaataaaaatcca

SEQ ID NO: 67795 - DNA, 2047 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67796 - DNA, 2436 bp, Homo sapiens
atttcttttagtgtctcagggtaagggaaaggctaggtacctaccatgtatgtgcttattgttttaattctcatcactctttggagatgggaatttgtatccccttctacagatggagaagctgaggctcagagggttgaatgggctccccaggcttacacagctcgtgagacacacataagcaccctggtcagagtgatgtgtggcgctcaaggtccatgcagtctctttcctctgggagtttgactagcccagctctggggtccccatgtaagggcaggggcagggtggactgggctcctctcgaacccctctttggctgcccctgccagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcaggtgaggatggagtttgggggaggagcccagggcacctgatgtggaggggagatccctgccccactttctctctgaaccactccttctgggctgaccagtgagtcccccagagggtggcagttttgagccttgcctcaggcctggtgagtggggcaggcagacaagttccggcaagggagcagggaagatgccccgctgcccggcgctcattctatatctgcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67797 - DNA, 604 bp, Homo sapiens
atttcttttagtgtctcagggtaagggaaaggctaggtacctaccatgtatgtgcttattgttttaattctcatcactctttggagatgggaatttgtatccccttctacagatggagaagctgaggctcagagggttgaatgggctccccaggcttacacagctcgtgagacacacataagcaccctggtcagagtgatgtgtggcgctcaaggtccatgcagtctctttcctctgggagtttgactagcccagctctggggtccccatgtaagggcaggggcagggtggactgggctcctctcgaacccctctttggctgcccctgccagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaaggtaggtgcctagctctgctctgtacatccccctccagctgaggcttcagcccagggaaggaggctgtgacctctaagttaagagtgattatctgttttgtacc

SEQ ID NO: 67798 - DNA, 571 bp, Homo sapiens
tttccaaataggatccctgtcttctagctaggcaaaggtctcagagacgactgaagcccaatccccactttcgaaggagcccgccctccaggaagaggactaacagatccagacaggagcagcctgaaaggggaggcagatggggctttggatagcctcacactagcaatgctagtcccactgtgtcccacctctctgtgaccttgggcaggttactgatcctctccaggcatcaggttctcctgtgtagtgaattcatctgctcagctaaccagtatgttagctgagttccagctgagctcagtatgttctgagcaccttctctggcctggctctgaactgagccctggggacataaggagaaggcagcagccttggctcctgctccaaggggctcctgggcttggctgtccagagaagcagaaaccaagcacgtcatcacaagtgctttgatgggggaagtgcaggtagctgggggagtggcatggggcaggggcccagttctcagcagcagacactctgtacagttttttcaatccctgtttttgaataaatattctcagcgaccagg

SEQ ID NO: 67799 - DNA, 156 bp, Homo sapiens
gcggccgcctactactactactgctcgaattcaagcttctaacgatgtacgggtagctgggggagtggcatggggcaggggcccagttctcagcagcagacactctgtacagttttttcaatccctgtttttgaataaatattctcagcgaccagg

SEQ ID NO: 67800 - DNA, 2130 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagcctctggagtccctgtggcagaactcaaatggaaggaggagcagctgcacccaggggagcagggtgtcacctccgttggatagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67801 - DNA, 2490 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgggtgagccgccgggctgggcggcagtgggggagcaggtcacggttctcatgtgcccaagaaaggcaggggtggggagaggaagctggcctcctctctctgtctgggcccgacctctgcctctcctaaccctactccaattccccatggtctttgcctaattcaccctctgttgccccatctcccccctctatatccacctctcattctccattgctgtgtcttttccctgggtctctggccaccccatttctccctgcacctcgtgctatatctgcttgtcctttcttcccttcctcttccacctttcccatcttccccttattgttctctgttcactacctctctcttgcctttcatctaatctcatgcccatctctgccctcattgcccctctctcactcccactttcccctttgtctcccctctatatccctctctccagtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67802 - DNA, 1850 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67803 - DNA, 2620 bp, Homo sapiens
  misc_feature (285)..(285): n is a, c, g, or t
caggcagtaagatcacacacaaggtgtcacttcacatggagggttgcacagcagctgggcaaaggcgctcctcacttcccagacaatggggcggctgggcagaggtgctcctcatttcccgggtggtgaaaatgggttatcttttaaaggccgtaccttcagaaatagggagagcttaacaggagatatttgggggcaatgattcacacctctttctataaaaggttgcctcctccccaggggccccttaaaggctgaatctctgtcattattctctaaggcatnggttctcaaatgacgcactgagggcatagtcactgaaatcgatatttggatgacttccaaattcatatcttcatatatcttcatccctgacttcctctgacctttagacttttgcataccccgcccatgcggcagctgggggaatgtctagcaagggcagccagcatgaggctggccaggatgctcggagagcacagtccctgcatccactgctcatctccagcctctggagtccctgtggcagaactcaaatggaaggaggagcagctgcacccaggggagcagggtgtcacctccgttggataggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67804 - DNA, 1923 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttggggtagctgggggagtggcatggggcaggggcccagttctcagcagcagacactctgtacagttttttcaatccctgtttttgaataaatattctcagcgaccagg

SEQ ID NO: 67805 - DNA, 1843 bp, Homo sapiens
tctagagtatcccaatatctgtgaaatgtgactggtgcagagagccagagcttaatatatgcctcacgtcaaggatttaatttcacagcaaggaagtgttgatcatctatagagaagaaccggctgagactgattactcgcacattccagagaggcacaacagctagtcctgttcagtatctccgagaactcttgtcctgagctcataaacatcttaaccggctctaactatcatgctttgcatatcatcatcgctgattgctttaaatcttggattacgagcttttgcttaggtctagcgaattctagattctttctcctggtctctcactatccttgtcttagatatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67806 - DNA, 1918 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67807 - DNA, 1464 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgggccgccgccgggcttggcggcctacactgccaagatggcagcagctaatgggagcaagaatcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67808 - DNA, 2361 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgggtgagccgccgggctgggcggcagtgggggagcaggtcacggttctcatgtgcccaagaaaggcaggggtggggagaggaagctggcctcctctctctgtctgggcccgacctctgcctctcctaaccctactccaattccccatggtctttgcctaattcaccctctgttgccccatctcccccctctatatccacctctcattctccattgctgtgtcttttccctgggtctctggccaccccatttctccctgcacctcgtgctatatctgcttgtcctttcttcccttcctcttccacctttcccatcttccccttattgttctctgttcactacctctctcttgcctttcatctaatctcatgcccatctctgccctcattgcccctctctcactcccactttcccctttgtctcccctctatatccctctctccagtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67809 - DNA, 1418 bp, Homo sapiens
tttccaaataggatccctgtcttctagctaggcaaaggtctcagagacgactgaagcccaatccccactttcgaaggagcccgccctccaggaagaggactaacagatccagacaggagcagcctgaaaggggaggcagatggggctttggatagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67810 - DNA, 869 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagatctgcctgtatcctgatccccacccactcgcctttagagatcctcta

SEQ ID NO: 67811 - DNA, 2603 bp, Homo sapiens
atttcttttagtgtctcagggtaagggaaaggctaggtacctaccatgtatgtgcttattgttttaattctcatcactctttggagatgggaatttgtatccccttctacagatggagaagctgaggctcagagggttgaatgggctccccaggcttacacagctcgtgagacacacataagcaccctggtcagagtgatgtgtggcgctcaaggtccatgcagtctctttcctctgggagtttgactagcccagctctggggtccccatgtaagggcaggggcagggtggactgggctcctctcgaacccctctttggctgcccctgccagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcaggtgaggatggagtttgggggaggagcccagggcacctgatgtggaggggagatccctgccccactttctctctgaaccactccttctgggctgaccagtgagtcccccagagggtggcagttttgagccttgcctcaggcctggtgagtggggcaggcagacaagttccggcaagggagcagggaagatgccccgctgcccggcgctcattctatatctgcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagaggtgaggggcgagatataccacccacagggaatccggggcaagggagcagttgtaagaggggtgttgggcttatggcgtcctccccacctagagagctctgagcctgggcagcccttttctgggttatgggagcagccagaagtggcccctgttctctgtttgcagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67812 - DNA, 2138 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgaggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttggtaggtgggagtgtgcctcaattcccccctcaacccctgcctcaagcctttaccaggcagtggcaagacctgaccacacccgaggcctccctgccttcaaggcttcccatggctgctccagcttcctccccagctgctcttctgtgctccatccaccatctggctgctggacgaaagtgcctctcatatggaagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67813 - DNA, 2374 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccaggaaaaaaaaaaagaaaaaaaaaaaagaaaaaaaaaaaaaaaaaaaaaaaaaaaaaaaaaaaagagagaagaaaaaaaaaaaaaagggggggggggggggagaaaatcccctcccgggggggccgcacaaagacgagacgcccccgcggctaggtgggtgacaaaagagagggggcccaccgaaagagggagacggcataaatacgaccgcaaggagaaccgacgagggcggccggaaaagccaacaagagacggcgaagcgggcagaaaaaaagagcacggaggaacaaaacttgggggagagcagacacaacctacacgcgcgagaa

SEQ ID NO: 67814 - DNA, 2195 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgaggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttgagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67815 - DNA, 1996 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggggtagctgggggagtggcatggggcaggggcccagttctcagcagcagacactctgtacagttttttcaatccctgtttttgaataaatattctcagcgaccagg

SEQ ID NO: 67816 - DNA, 2387 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgaggccatttccagcacatagaagagagattggaaaccaacgtgcagaactgccagtcccctgacacgctgtgccccacccactgcagcccagtgctgaatgaaccctgcccagaggtgtctgtagtgagcttctgccctagtgacttttggtaggtgggagtgtgcctcaattcccccctcaacccctgcctcaagcctttaccaggcagtggcaagacctgaccacacccgaggcctccctgccttcaaggcttcccatggctgctccagcttcctccccagctgctcttctgtgctccatccaccatctggctgctggacgaaagtgcctctcatatggaagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67817 - DNA, 1705 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67818 - DNA, 1516 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggtagctgggggagtggcatggggcaggggcccagttctcagcagcagacactctgtacagttttttcaatccctgtttttgaataaatattctcagcgaccagg

SEQ ID NO: 67819 - DNA, 2424 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgaggtagggcgcgggccgggcggggcacggcgggccgcgaagtttgggggttcgcccgggggcagggagcccgcgcccagatccctcggttggggtcgcaggtttgtgagactgcgaggaacacgttctctgtcccacaccgctgaggcctgcacagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcaggtgaggatggagtttgggggaggagcccagggcacctgatgtggaggggagatccctgccccactttctctctgaaccactccttctgggctgaccagtgagtcccccagagggtggcagttttgagccttgcctcaggcctggtgagtggggcaggcagacaagttccggcaagggagcagggaagatgccccgctgcccggcgctcattctatatctgcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67820 - DNA, 1535 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggcccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67821 - DNA, 1498 bp, Homo sapiens
tgatagcgcatgcgaggcccccggtggtaaatcggccgaggctgcaccaagatcaagagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67822 - DNA, 2001 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagcctctggagtccctgtggcagaactcaaatggaaggaggagcagctgcacccaggggagcagggtgtcacctccgttggatagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67823 - DNA, 1526 bp, Homo sapiens
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagagactacgggtgcccaggtacaggtggcaggggacctgctccccaactccacagagcgagctgttacggtatctggggtgcctgatgccatcatcctgtgtgtgcgccagatctgcgctgttatcctggagtccccacccaaaggagccactatcccctaccatccgagcctctccctaggtactgttcttctctctgccaaccagggcttctctgtccagggtcagtatggggctgtgaccccagctgaggtcaccaagctccagcagctctcaagccatgcggtcccctttgccacacccagcgtggtgccaggactggatcccggcacacagaccagctcacaggagttcttggttcccaacgatttgattggctgtgtgatcgggcgccagggcagcaagatcagcgagatccggcagatgtcaggggcacatatcaagatcgggaaccaagcagagggcgctggggagcggcatgtcaccatcactggctctccggtctccatcgccctggcccagtacctcatcactgcctgattgctgtctagagacggcaagtcctaactctggggggacgcccaagttcggctcccggagcactgactgcccacagttcacggcacccatgaagggcctgagacaacggaagcccctgactcgatgggaacacctatgccatcctctccagcgcaatcggccaagacatgcccactggttagcactgcaccccaggcggcggcagggactgaggcacaaggccagaaggggcgaactgagaaagaccggagagggcgaaaccccacggcgacagcagaagggggactgagcaacatagggctagacacgaaagaaccacggtcaacgcgaccgacgaggaccaacagacacagaaaacagggagacagagcg

SEQ ID NO: 67824 - DNA, 1241 bp, Homo sapiens
  misc_feature (21)..(21): n is a, c, g, or t
gagtgcccttttttttggccnactttctttctaccaatccaattccccatggtctttgcctaattcaccctctgttgccccatctcccccctctatatccacctctcattctccattgctgtgtcttttccctgggtctctggccaccccatttctccctgcacctcgtgctatatctgcttgtcctttcttcccttcctcttccacctttcccatcttccccttattgttctctgttcactacctctctcttgcctttcatctaatctcatgcccatctctgccctcattgcccctctctcactcccactttcccctttgtctcccctctatatccctctctccagtctagagacggccaagtctacctctggggggacgcccagctcggcccccgcagacctgcctgcccccttctcgccacccctgacggccctgcccacagctccccctggcctgctgggcacaccctatgccatctccctctccaacttcatcggcctcaagcccatgcccttcttggctttaccacctgcttccccagggccgccgccgggcttggcggcctacactgccaagatggcagcagctaatgggagcaagaaggctgagcggcagaaattctccccctactgaggccagctgaggtacaggcaggggcaggcaggaccaccagcagggggctgcctctgcaccctacccgcccaaggagactccaccctggggtcccaaacgccgctaacgcccagacgcatggatgcaccccctaccctgcctccatctatgggagttctttctctcagagtgggggcagtttctggcccaggggtctgagctgcggcagccccagggcagggggccctacctcctcagctctgtgcttggatacagggagcagccaggagactccctagtgcccccaccatggcgggtgtcactcacgcactccccatcccttagggcttcctggcctactgcatccttgtgggagtcagggaggagggcccgttgggtagctggggccaggcttctctccccaccacctgcagatttcttgctgcttccactgatacccttttgactggaatgaactggctgggcttgtcagggggcaccccaaagagggggcactgccaggtagctgggggagtggcatggggcaggggcccagttctcagcagcagacactctgtacagttttttcaatccctgtttttgaataaatattctcagcgaccagg

SEQ ID NO: 67825 - DNA, 1185 bp, Homo sapiens
  misc_feature (1180)..(1180): n is a, c, g, or t
agccgggctccgggccggccgggctccgcgcctgtcataacccctcattgttcgcagctgatgtcactcgcagttgtgagcggccgcctctcccggggacaatgtgggactgagcggcccagccgccgtgccgccgccgccgccgccgcaggacagccccagcgaggtagggcgcgggccgggcggggcacggcgggccgcgaagtttgggggttcgcccgggggcagggagcccgcgcccagatccctcggttggggtcgcaggtttgtgagactgcgaggaacacgttctctgtcccacaccgctgaggcctgcacagagccggccaggttgcagcgcggacacactcgcaggtcgctgtggccccagcctcgcctgacagaatgagcggctcggacgggggactggaggaggagccagagctcagcatcaccctcacgctgcggatgctgatgcacgggaaggaagtgggcagcatcatcgggaagaagggcgagactgtaaagcgaatccgggagcaggtgaggatggagtttgggggaggagcccagggcacctgatgtggaggggagatccctgccccactttctctctgaaccactccttctgggctgaccagtgagtcccccagagggtggcagttttgagccttgcctcaggcctggtgagtggggcaggcagacaagttccggcaagggagcagggaagatgccccgctgcccggcgctcattctatatctgcagagcagtgcccggatcaccatctccgagggctcctgccctgaacgcatcaccaccatcaccgggtctacagcagctgtcttccatgcagtctccatgattgctttcaaactggatgaggacctttgtgctgctcctgcaaatggtggaaatgtctccaggcctccagtgaccctgcgccttgtcatccctgccagtcagtgtggctcactgattgggaaggctggcaccaagatcaaggagatccgagaggcgaccttatccggcagttttcgggcgctcatcgtacaggtccctgggcacctttgccccgactcccctgaccgagatgttccggaaactgggccgcttcaagccatgattttgtgtgggggccaaatgggccttgctattggccagtccccacccaaagaagtctctgtccgggaccattttcancaatt

SEQ ID NO: 67826 - DNA, 813 bp, Homo sapiens
tccgcggcgcgacgctcccacggacttagctgggatgcagaatagaagctgggcctttgtctgactaccctgcaacagtcagccacagacgggaaggcagcgcaggaaactgaggccaaaggagccgcgcttcctcatgagcatgaagcggcaaagcctgaactagaagcttctaacgcctaaccgtcctcttgccgcaccaggacctacctctgcaaggcccttcctgactttttccttagaatgtgtgtatatgtgtctttttccttttctgatgctaagacacctcagaaacaccaatgttaagcagatttccatcgttggaggttaaaacacccgaatacaagtgttttcttgagtgtggcatctggtcagatgttttatgggttggtttgtttttaaaaaaaaaaaatttcctgttagatgggtggtaagaaccagtcagagtttgtaaacccaccaagcacgaggcggtcggaccgtccagattctggagtccagaagacaccaaacgttctcagaatgccgaacgcgggcgccacctggtgggactagaacgcttattgtcccaaatcagcatagcacacagttcccataaatcttaaaaattcccatccaaggctcatttccgtgtgactaaaagtcatattctctgttctcgtgactccaagtaaaaatgtccctaaagagccaaagtatcttcactgtataaactaataatctattggtttggggaattttattttttgtgatcaatgttactttagcctttctatgatatacatataaataaaaaagttttcttccatgaaa

SEQ ID NO: 67827 - DNA, 276 bp, Homo sapiens
aaggcgagaggcttctggagaaacccaccccaccaacgtcttgatcttggacttttagcctccagagctatgagaaaacaaatttctgttcttgaagccactcagcctgtgatactggcagccctagcaaactcatacacacatacattttaaactcggtttaatcctgtgaccattcacttatgttcagtttttaaatagtcctagtcttatgaccactgttaagttcaccaaaacaaaggccattggggaaaggggcctgtaactcttgattga

SEQ ID NO: 67828 - DNA, 479 bp, Homo sapiens
gcctgagcaatctgacgcagaggcacatgaggaatcagcacggaaccatcgacccacagggttaatcccaatgtcaatacctgctagatgtcagggatcccctgggctgctggcgagccatttgaaatgacccatctcctgccaccttggcctgctcctctgggccacctctctccacctgcacttgcttaccggaagacggcaaggccaccggtgcacttcgcagtgccaggagaaaggcgcctcatgctattagctcaaataaggaaaatcatgccgggaagattgaattttctgcagacttgtttaacctggtgatttctgagcacttggcgctggcagccacgggggagtgggctccagccggcactttatcagccacttctcaggactattcctaagcttattaaatcagcatgagtcactcccttgccttcctcacaagcatgaatcacgaatcatcaaaacccaagcaaaat

SEQ ID NO: 67829 - DNA, 375 bp, Homo sapiens
ttgtgaaactactagtaataaaagctcatcctgtttctcttcaaaaagcagaattacttgctttgccatgttctccctctgctctacctcttactattttgtctcatgttgtatttatgtacatgtaccactccttgaatacagggtgaactcctgaaaaagcctgttacccttaacattttaaacaaacaatccaagctcagtttcagaccctcattgtatccatcctggattgctggcttaggctcccaagggatcttcatttgcctcattttctttttcttttttgtccacaagaaactctcttacaaattttcattcgtgagtcatttcctcaaaaaacaaaaaacaaaaacaaaacaaacaaagaaacaa

SEQ ID NO: 67830 - DNA, 530 bp, Homo sapiens
catttgtatgcaacaccatttgggttaaatacaagttagatgacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgtta

SEQ ID NO: 67831 - DNA, 405 bp, Homo sapiens
gaaatggtgtctcgctctgttgcctaggctgtagagcagtgagccaagatcgcaccactgcactccagcctgggtgacggagtgactccatcacacacacacaaaaaaaagcatgtacccctcaaccataaaattacatattccaagctcatttgactcttaaagttttgattattttaaagtcagactcttacaaagtatggaggcagggagggtttatgacagtctgggggttttagtttgatgtgatgtttaccttggaaagatatggaaatgattttgaaatttggagattctaaaaggatgtggatggggaaaggagtatgtgttttgttgattctgttaccaggaggttcccatactgtccatggaacccacagactcaggtagaaccggaaggtgaaa

SEQ ID NO: 67832 - DNA, 3001 bp, Homo sapiens
tgatgccatcaagtgttgcaggagaaacttcagtcttggctgttccttcttggagggaccactcagtagagcctctaagggacccaaatccttcagaccttttggagaacctggatgaacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtatcacatcacttctcaagtattccttcattgggcttcatccttttagcagaactcttggtggtgggatagagacttagggagggtagggggagagtgtggaaataggtgcttcctttggctggcaaatgtctacatcttgaaacaaacagatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggcttttatccttaaagagaatatgtccccagattattagcacttttagaggagaagccaaggtatgtagggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgttaaaaattgaacttctgcttcaatttattatatttattggcaaacaaacaattctgcttgtatatttgaaacattggaaaaagaaatccattttctcaataaaaaagaataacacatta

SEQ ID NO: 67833 - DNA, 2884 bp, Homo sapiens
tgatgccatcaagtgttgcaggagaaacttcagtcttggctgttccttcttggagggaccactcagtagagcctctaagggacccaaatccttcagaccttttggagaacctggatgaacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtatcacatcacttctcaagtattccttcattgggcttcatccttttagcagaactcttggtggtgggatagagacttagggagggtagggggagagtgtggaaataggtgcttcctttggctggcaaatgtctacatcttgaaacaaacagatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggcttttatccttaaagagaatatgtccccagattattagcacttttagaggagaagccaaggtatgtagggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgtta

SEQ ID NO: 67834 - DNA, 2900 bp, Homo sapiens
tgatgccatcaagtgttgcaggagaaacttcagtcttggctgttccttcttggagggaccactcagtagagcctctaagggacccaaatccttcagaccttttggagaacctggatgaacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtatcacatcacttctcaagtattccttcattgggcttcatccttttagcagaactcttggtggtgggatagagacttagggagggtagggggagagtgtggaaataggtgcttcctttggctggcaaatgtctacatcttgaaacaaacagatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggcttttatccttaaagagaatatgtccccagattattagcacttttagaggagaagccaaggtatgtagggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttccaagccaaactcccatggcctccatgactttttcaaaaaaaaaa

SEQ ID NO: 67835 - DNA, 2608 bp, Homo sapiens
tgatgccatcaagtgttgcaggagaaacttcagtcttggctgttccttcttggagggaccactcagtagagcctctaagggacccaaatccttcagaccttttggagaacctggatgaacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtatcacatcacttctcaagtattccttcattgggcttcatccttttagcagaactcttggtggtgggatagagacttagggagggtagggggagagtgtggaaataggtgcttcctttggctggcaaatgtctacatcttgaaacaaacagatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggcttttatccttaaagagaatatgtccccagattattagcacttttagaggagaagccaaggtatgtagggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttcctaatgctttatactgggtactgagctctcaatcttaatctttgtcgtcgctctttcc

SEQ ID NO: 67836 - DNA, 381 bp, Homo sapiens
ggcgcacacctgtaatcccagctactcgggaggctgagacagggagaattgcttgaacccaggaggcagaggttgcagtgagccaagatcgcaccactgcactccagcctgggtgacggagtgactccatcacacacacacaaaaaaaagcatgtacccctcaaccataaaattacatattccaagctcatttgactcttaaagttttgattattttaaagtcagactcttacaaagtatggaggcagggagggtttatgacagtctgggggttttagtttgatgtgatgtttaccttggaaagatatggaaatgattttgaaatttggagattctaaaaggatgtggatggggaaaggagtatgtgttttgttgattctg

SEQ ID NO: 67837 - DNA, 562 bp, Homo sapiens
aagcatgtacccctcaaccataaaattacatattccaagctcatttgactcttaaagttttgattattttaaagtcagactcttacaaagtatggaggcagggagggtttatgacagtctgggggttttagtttgatgtgatgtttaccttggaaagatatggaaatgattttgaaatttggagattctaaaaggatgtggatggggaaaggagtatgtgttttgttgattctgttaccaggaggttcccatactgtccatggaacccacagactcaggtagaaccggaaggtgaaagattttacgttcctggaagctggaaattagttagtatatgtgtgtaactaatatatggtgataaatagcttatcagctgcttttctttacacagaacctggatgaacagtgtgttttcgaagcggcatgcaaaactggagctggatgagaagagaaggaaaaggtgaggccagagatgtccatcctggaaacaactgagccctaggacctaggacagagtatcagggaacctgacctccctttttcatgctgtggagaatcttgg

SEQ ID NO: 67838 - DNA, 3155 bp, Homo sapiens
ggcattttaggttcttttataccatagcaaggacactgaatatggcttcagggaggccatagaatggattcctatcacttggtaactttgtctcttctggggagagacctcttatcctagtgaatagttgtgcaactttggatttaagggtggttccacccctcctccctttctttttctctctcttttttttcagttccttcttggagggaccactcagtagagcctctaagggacccaaatccttcagaccttttggagaacctggatgaacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtatcacatcacttctcaagtattccttcattgggcttcatccttttagcagaactcttggtggtgggatagagacttagggagggtagggggagagtgtggaaataggtgcttcctttggctggcaaatgtctacatcttgaaacaaacagatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggcttttatccttaaagagaatatgtccccagattattagcacttttagaggagaagccaaggtatgtagggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgttaaaaattgaacttctgcttcaatttattatatttattggcaaacaaacaattctgcttgtatatttgaaacattggaaaaagaaatccattttctcaataaaaaagaataacacatta

SEQ ID NO: 67839 - DNA, 2947 bp, Homo sapiens
tgatgccatcaagtgttgcaggagaaacttcagtcttggctgttccttcttggagggaccactcagtagagcctctaagggacccaaatccttcagaccttttggagaacctggatgaacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtatcacatcacttctcaagtattccttcattgggcttcatccttttagcagaactcttggtggtgggatagagacttagggagggtagggggagagtgtggaaataggtgcttcctttggctggcaaatgtctacatcttgaaacaaacagatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggcttttatccttaaagagaatatgtccccagattattagcacttttagaggagaagccaaggtatgtagggtgtgtggctggcccatcagtggagcacgaagagagaatgggataccattgtgggaagagaagtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgttaaaaattgaacttctgcttcaatttattatatttattggcaaacaaacaattctgcttgtatatttgaaacattggaaaaagaaatccattttctcaataaaaaagaataacacatta

SEQ ID NO: 67840 - DNA, 2949 bp, Homo sapiens
tgatgccatcaagtgttgcaggagaaacttcagtcttggctgttccttcttggagggaccactcagtagagcctctaagggacccaaatccttcagaccttttggagaacctggatgaacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaaaactctttcattcggctaattgtgagttatggagggtgattgggatttcttttcccttttttgggaaatgggctctcaagctaaagctataggatggcagattcagaagtttcaggggtctgtttctatacatttgcctatgttaaaggggtaaaagggctctcttcattagacatgtggaagatgaagcagccccttcctttagagctgtgcctgcatggcactcttctcaccctggtacaccctccttatagtgggtatagtgatttttaaccctaaaataaaacaaacaacctcaccatgagctttaggaccagaagaggaatgacaagtgaagcgatgaagcaagccatcttcacagagtagaaaagacatcggagagttggtagataactgtctgaaaagatagttgttcatttgaaactattctgtgatacagtcatgtgggaagggatgtttggctgtgattattttttcagttaatggataacaatttctttactgctcaaaaaccaaaatctttggaaaagaaagtggggatggttagtttcagaacaagttacagctgtaaacaaaagcacttagtatttgggatggcatgccaaaacctgtataaatgtccttgtatcacatcacttctcaagtattccttcattgggcttcatccttttagcagaactcttggtggtgggatagagacttagggagggtagggggagagtgtggaaataggtgcttcctttggctggcaaatgtctacatcttgaaacaaacagatgtacctaatgagcttctccattcactttgtaaaaataatttgtatgtgtaccatcttggtcctctcccctcccgttttgttaaaatatcaggatagcactcccaggccactttggtctcagtgtaagatccctattaactatctgaaaggaaaatagagccaagacctctggtctcaaatatataggaattgcctttctttagtcttcaggactattgtgtgaaaacaagtaggggtctaatctcctagaaggtaggggcttttatcgtatgtagggtgtgtggctggcccatcagtggagcacgaagagagaatgggataccattgtgggaagagaagaaaagttcctcaggggcctcccactgctaaagttttttgtgagatgttgatctgtgcttcctggatttgacttttaaaggaattattctggcagcacatgtagtattcttggatgatcttgctgctcttatttctccttttgtgtgtgtgtgtgtgtgtgtgtggctatgggttttcatttgtaactccatctgcttaggagagtgggctctctataagggaacctgctgtaaacttcattgcagcaaggatgtagagagaaataggacttaattccactaggggctctcatctcacaccttaaggaggagatttctagaaaaactgggccagattttctttgttctccatcattttaatgtggcaggctgttcagttttcttactcttacctatgtgatatttcttcgtaacgtgtccaaaaagaaaaaagacccaatcagtgtctcttgactttgttctttgatccctcagtttcttcttgatttcagcatgtgtcgggttcctaattttgggtatgagttagcaaatttaaccattgtgtttgtgccctacccaggggactccccagtttctgacttgaagtagactgagaagaatccacgaggtgctatctggccagatttaagtagattctatttccttggttctccctctccctgaggacctcttattttattgtcccctcttctaggttaattctcctttgatttgactttgttgagaaggaggttggacagtagattagcaaagttccaagtgcaaaattacagtgtgttagagtgtggggggaaaattagtcttatttttccctacatgggatacaacactgtgaattcaatcttcaactgaaggccctgcagttctcctaaaacatagttgtttgtttttctttaacaaagtttaagctagtgttaataaattaaaaaaaattgcttgtctgtctacttcagctttgttttatgcccatttcatattgttgtctgtgttgtaattcataacttttgataccatttctgatgtgtaaaattggttgtcttgtaaatatcttataaagagttcaattgtaaataaactattgtggctgttaaaaattgaacttctgcttcaatttattatatttattggcaaacaaacaattctgcttgtatatttgaaacattggaaaaagaaatccattttctcaataaaaaagaataacacatta

SEQ ID NO: 67841 - DNA, 686 bp, Homo sapiens
tgatgccatcaagtgttgcaggagaaacttcagtcttggctgttccttcttggagggaccactcagtagagcctctaagggacccaaatccttcagaccttttggagaacctggatgaacagtgtgttttcgaagcggcatgcaaaactggagctggatgagaagagaaggaaaagatgggatattcagaggatcagggaacaaagaattttacagcgactgcagctcagaatgtataaaaagaaaggaattcaggaatctgagcctgaggttacctcatttttccctgagccagatgatgttgaaagtttgatgattacccccttcttgcctgttgtagcatttggacgaccattaccaaaattaactccacagaattttgagctaccctggttggatgagcgtagccgatgcagattggagatccagaagaagcaaacacctcaccggacgtgtaggaaatagctgtgctggcaagaaccctgtcttcagatagttgtagcatgccattcccgagagtggcagagacctgtatatgtgacctttgtcctcacatatgttatcactcgctgataataccctttcatacttccttgactttgttttcattactctgatttcacaaagtcaaggaagtatgaaaggggtcgacgcggcccggaaattagtagttataagcccaaccc

SEQ ID NO: 67842 - DNA, 470 bp, Homo sapiens
agtatatgaaaaaaaatctggtgtcatacacatatataattgggaaatggaagagtatttacacaggcttttttagatattcttcctttatactacatcaaaacttgataagttgcaatgttgtgaattggcccagggcttggccctctgaagatttgctgaaaatcactgacatgaagtagattaataggataaaaggcatatacatttatttaatgtgtatacacagcggcctttagaatgaagacccaaagatacagaagaaattgtctgtttttatgcttaagtttaacaaagaatgggcagccgtgtagagataggataggacaaaaagggcataatctaatgctagctgactgagtgaggaagcccagcaaggcctgtcagtgtctcctcagtatgagtgaattttgtgtactctgataatacattaaaatctgtttatgtactctgataacacattcaaatct

SEQ ID NO: 67843 - DNA, 266 bp, Homo sapiens
gtgatccacctgcctcggcttcccaaagtgccgggattacaggtgtgagccaccgcgcctggccttacttctttttctattagactgtttatgagatataatttttcatctattagttgggcagcaatcccgaagtttaaaaacacacttgtgttcagaggatgttaatgggcatataaattggcaaaaactcacgttcaaaatttaaaatgcacacactttaagacccagcaattccacgtcaaggaaatcattcatatacttcc

SEQ ID NO: 67844 - DNA, 566 bp, Homo sapiens
ttagtacaaacctgagctaggaaataataacagagagctctttgtgccactgagtcctggaacttccccatactaattttgagaaggctttcttgtaagtatgtgacagatactgtttcctccactttctgtttattgcatataaccactattcttgtatgtaagtacgtataacagtttctttactattcccattattcagcgtttataatctggtttgacatatcagtgttggtgctgagagggaaaggtatttctaggtaggataaaatggtgaaaagtgatttaacactgttgtatgcttgcttttggccaggaactatagggcagtgtatcttaaactttgagtcttgagaccctcttacactcaaattctccatatatgtaaagaattgaaaacgagcttttatttatgtgaggtatttaacaatattgcattagaagttaaaactgagaatttaaaaatttctgttctcggccgggcatggtagctcacacgtgtaatctcagcactttgggaggccgaggcgggtggaattgcttgaggccaggagttcaagaccagc

SEQ ID NO: 67845 - DNA, 445 bp, Homo sapiens
ctacgcccctgttccacaagccataattatagctttggtgggacaagagactgatctcagtaactttctcctgataagaccatcggccatggactggttctagccagcttacagaggctgcgcacttgagtgcttttgtctttttgacgtatggggcctaactgcgatatatttaaatattaagtctccaccccaaggtgaacatggatggtatataacatgcatgtttgttcgatatgcatatgtcaggaccccttccgtaaatattcgtagctcctccagtaacctgttgaccaatccattcaactaaaattcctatctcactcctccctccctcaaagtgcctgttaaggctttggctggaggctctgcttcctagccagtgggatggccagcctgcaggttgtaaccctttataaaagagaaataaagtctccttttcaaa

SEQ ID NO: 67846 - DNA, 3513 bp, Homo sapiens
  misc_feature (1943)..(1943): n is a, c, g, or t
  misc_feature (3416)..(3416): n is a, c, g, or t
tttttccttctgacaccttctactgtgttcttgccactccctcccatcacctgcatttcctttcttaggtttctccatcctgggcccatttgccacaggtcagaccagcacaggcccacgctagcacgttgcccaggggcctccttcccttgggtcaggcccacttctctttcttagtcagaagagccctccacaaagccctcagaagattaatgcatttttttttaatacttgagaggcatttggtaggttttacagatgcccagtgacaattgcaaaggttaatttactttgagcttaaatagctaccagcttcaagaaaagtttattggccactagttctccaattacattttatctttctttagattgatttttttttttattgtaaagaaactggcatgtttgttcatccatgtttggtctctctacctttaggatttaacttcataattcgctgagtcaaacaacgcaggcagagctaaatttatacagggtcaacttttagagagcccacagcagtatctggtaggtatcaaacctgaatttttgtgactctatttttctttgtttctaacttctctgtgtataatcctggtttctctgtaccttctcagttgctcctcctgcatccctcattaatacctttttcctaactatgtcccttaagatggagctcttgccttgcttttttctgacaaaatactttattagaaaagaccatccattcttataacaatagctgtaagcttttgggaagctaaaggctcccaaagttgtactctagcccagtcttctttcctgagcaagaatcctgtcttctaaaggccccggacccctcctcctcactgtttaggagacaccccaacacacccactccaggccatcacctttccctcactttttcccaactctgctggtggccttgacagccaccgagtcactcgaagttaaaagactgtgaaatcatagaacagtgaaaactcctccacacatgttctcatagcaaaaccatgacatggataaagcaggtattatcattcctagtttacagatgaagaaacagatgcagagagattaaattatcccaatcacaaagtaaatggcagatttttgctatttaaaactggccagggcgggggcagaaacaaacctaaataaacaacttgaatattcagtcaaatatttatggaatgattaaatacataatgacatttccacacagtgggatattattcagatgttaaggaaagttaatttgaagaacatttgatgatatagggaaatgttcacattataacattgtcaaagaaggctcaataatctgtgatccctgtttttctgtatgtacgtatatacataaatgtgcatacacacacacacacacacacccctatacatctacccctttgtatatggagagggggagaaatctcccctcacagtcacacacgtaaacacttgagattttttgttaatgctcgagcaaaataaaccactctgtgatgagtgcataggtaattttaattgtcttctttgtagtcttccagatttgtcttcagtgagtacatgcagctttcagctggtaatttgcttttataaacaatagccaagtgagctgcagtgcctgttccccagctcatcctcctgcaggcttgtcccaggcccctccgtcctctcccttgaaatttgctcttccatcaattccctgtgttccagtcctctgtggcccccctcactggctccgcccagccccctgcctggggtgatccagccttctgccctgttcaccccctgccctagcctcagcccttgctttctctggtgcctccacccccatcaccacctcctgctctgagcccacctggcctagcctttgtgggcctccatgccatgaacagggtcagagcttgtaaatatgaggcctacagactggccaaggncactgcagcatcccagtctaaacgcacccgtgggtgagcctgtggactcagccatcttggctttcttgaaactcagcgtcgctgctgctcgctggctggcagggggtccacttggcagctctgacccacatgccctctgcaacccttcctctgtccttgacctctattccagatatgagtgacattcacttcccacattttcatttacctatactaattttgtgtttttattactttttaaattagagggggatacaacgacatttaaaagcctgttgtaacgggattgttagcttttaggaggtattggtctgccaccaccaccgtcagtccatcgttccaaaaaaatttattattgaggagtggtgtgatattaaatataatgtgaatctatttctgaaggaattagactgaaatttaattgaagattccttgtgcatcttgaagctaaaaataagagatcatacggtggccccagaatcccttactcccctctagcctcccaagcagaggtagcccagtcaggaggcttctagaaaaggaagtgcccaccatttagattcacatttaacagaatttttaacccagttttaaattagccccaatcacccttaatagttggtattccccatcagccaggattttgtctatctttatttactttcttggtttatattatgaaaaatgatttatccttactccttttcaggtataaaattatacagtcaggtgctgcataatgatattttggacgtgatagtagtccctaggcttacaatggagctaaaaattccttgcacctgatgatgttttgacgatcttgaccctttgtcggcagagactaatgtatgtgtttttcttagtttttaacaaaaaagtttaaaaagtaaaagaaaaaaattaatagaaaaaagcttatagaataaagatataaaggaaaaaataatttttgtacagctatacaatgtgcttgtgttttaagctaagtgttacaacaaaagtcaaaaagtttttaaaaatttaaagtttataaagtaaaaaagtttcagtaagctaagggtaatttatcactgaagaaagaaaaatgttttttataagattaatgtagcctaggtgtacagtgttgataaagtctatagtagtgtacagttatgtcctgggcctccacattcactctccactcattcactgactcacctggaacaacttccagtcctgcaagctctattcatgctaagtgccttagagaagtagaccattttttatcttttatactgcatttttactgtaccttatacatgtttagatatacaaataccattgtgttacaggtgcctacagtattcagtacagtaacatacggtacaagtttgtagcctaggagcaaaatgctgtaccatatagcctaggtggtagtgggcttgaccatctaggtttgtataagtacaccgtatgatgttcacccaatggcanaatcccctaatgcatttctgagaacgtagccccatcaagtcactcatgactctatgttgactatgctttttcacgcttccagaaaagtcccctcatt

SEQ ID NO: 67847 - DNA, 479 bp, Homo sapiens
caaatcgactggcaccttaatcttgaacttccagtctccagagctgttgggttatctcagaagcagaacctgagacaagaaagtgagtggaagcagtttatttgggagaaagtcccaggaagcactggtagcttacactcttggatcactgactctgagggaagccaactaccctattgtgaagctacacaccagctctgaagtgagatccacaagatgattctgtgagccgtcacaaggaatgaaagcctccagacaacagctgcatgagacagttagaaagaggaccctctagcacctgtcaagtctctagatggcaaaacctgagccagaaccacccagctaagcttctcccaggttcttggctcacaaaagctgtgaaaagaaatgtttgttcttttaagccattgagttttggggtaatttgttaagtggcagtagataactattaataataaaattgtattagatttttcaaa

SEQ ID NO: 67848 - DNA, 450 bp, Homo sapiens
gtaacaatcttgaattctaaattcttcctattttagtttcctcatctgttaaatgtagtttttaaaaactaaaaagcaaacatactcataagtcttttgagggattgcaagaggaaaaaaaaaatatatatatatatattttattttttatttaaaaaggcaatccaggaggggtgcggtgctcatgcctgtaatcccagcactttgggaggccaaggcgggcggaccacctgaggtcaggagttcgagaccatcctggccaacatggtgaaaccccatctctactaaaaatacaaaaattagccgggtgtggtggcatgtgcctgtagtcccagctactcgggggctgaggcaggagaatcacatgaactgaggaggcagaggttgcagtgagcccagattgtgccattgcactccaccctaggagacagagcagactctgtttcaaga

SEQ ID NO: 67849 - DNA, 258 bp, Homo sapiens
gtccttcaaaaatgagattcaaagcataccactaaaggaaatcacttcatcacaaaagaagatggcaagagaggaagaaaggaataacggatctgcaaaacaaccagaagacaatgaacaaaatggcagtagttaattcttacttatcaataattaccatgaatgtaaatgaaagaaatgaacaagaaacaaataaatggaaagatatcccatgtttgtggattaaaataattaacattcttaaaatgttcatattac

SEQ ID NO: 67850 - DNA, 601 bp, Homo sapiens
gctacagctagagccataatggtcttgtcctaccatctgaaagacatgttgattgctagaatgtttctgtggttaacaagataattcctctgataagtgaacaccttcacttaaatgcaaaaattatgactcatagattattaatttgtcacaatttactaaccctatcattggcctattgatgtaagttattcttgtcacgcttcacctacccagacgctaaagcatgtaaagcaatagttaagtttattgttcatctgattgacctggagggcttgttaaatgccattactgggctctaccttatgttttcaattcagtagggctggagtgaggctcaataatttgtatttcaagtgttgctctggtgtggaccacactttgtgaaccctttaaagcttcttgtcagtcacatgtttgtaagcagcactgtcttcctctgttctcttatttctatagctgcacacccttaaggcttgccctagtgtcaaaagtggatgctagttttatgtcttttttctagaggaggaaaaaccataacctagagaagtatctttccctgcatacatagtacattgacagaatctggaagatgcccttt

SEQ ID NO: 67851 - DNA, 274 bp, Homo sapiens
ctgcctgggctcacagggactgcagggggtatgattcctattcccataccagctttgtcaaagcacttgtcccagaagtggatcccatccctaaaacccattttaggcagagttgtgacacaggtgactggcattgccccttcccttctacacaggcccactgtcctcattatcttttgggaaacactagatttctccttagtgctgccttcctgcctacagcccaacagattcaaactgcggtcccggctcaatatatatttgatttgagttt

SEQ ID NO: 67852 - DNA, 5065 bp, Homo sapiens
  misc_feature (964)..(964): n is a, c, g, or t
  misc_feature (994)..(994): n is a, c, g, or t
  misc_feature (5009)..(5009): n is a, c, g, or t
  misc_feature (5040)..(5040): n is a, c, g, or t
  misc_feature (5065)..(5065): n is a, c, g, or t
gaacaatttgcagactgtggagagatagccttcagtgtaaaatgaagatgcaattcctgagaacaaagggaaggtcccgggttttatagcaaaagtgcccactcaggttctcaatcaggtccatatagcaaatgaaggattgaaacacgattagttctgactagttggtgctgctgagccctgattggctgaggctggtgagttctaattggttggttcgcattagctctgaaagtccaaaagttgaatggaggcatgggttttccaggaactcagagcacatgtgtgacctccaatcagcaaatggttggttggctgtattttaaatttagacccggttagccactcaggatccatcttagaggattggctctttcatgttcacatttgttcacacttattttgaaattttcagtctatcagtattaatgtagtttctgattatttaaatatcacatgtcagaatgaactccttcaaactccataaggtcttaacccagaatttttagagtgctaaccagtattaataaagcagcaagaccagaggttgggttcttgtattgttgcttgaagcagtgttaaagatacaccgacatgactaaaatgcattgctgagtaaacaagcacggattttaaagtttaatatgattaatgcaacttgatgccaaactctgaatgtctcctaaggcttccaagttactgaaaagcagccaatatattttcccaagtcatagatttgatgcaatccatgtgccttttattttaacatatttgttgccgttttaaaagttgccgtctgaaaaagtgctgaaaaaatgaagaccttttacttctgccgaccagttagactgtgccttcttcttttttttttttttttttttgagacggagtttcactcttgttgcccgggctggagtgcaatggatcaatctcagctcaccgcaacctctgcctctcgggttcnagcgattctcctgcctcagcctcccaagtngctgggattacaggcatgcaccaccatgcctggctaattttgtatttttagtagacacagggtttctccatgttggtcaggctggtctcgaactcccgatctcaagcgatttgcccgcctcggcctcccgaagtgctgggattacaggtgtgagccactgcgccccgcctatgttactttctttattcattttagcagaacaaactacagacagagccgcttgtgattctactcttgtcataattatttatgctctgccatcctcctggtcatgttttgtcttcgaaaacacaaaaacagtttattagtagactttgctctgcatacatgggccatcctgtggttgtcctgtaaaataatacaagctagtagtactgaaacatttagtattcttcagggttttttattttgttttccgagtgtagttcagttgtaacccaccattcctcgtttaaaatacaattcttagtttccatctcaagaattcagaaaaggaatcttgcgttttaagtttataataatgacagagagaccatcttttcctgtgatttttcaaaatgggtaggaattatttgctccagcattttctacctactctctggagtctttagggcatgagtagttctagctagccagtttctggagtagctgtgaatgttaaccaaattctgtccaaaatgactataatttcctttcagtattttataatacacttttctactatcttaaagaaagtacttgaacaaaatttaaacttatcactgtctcctgttttataattgattaaagcactcagccccacttgagatgagtatgacttttgcctttatatagagagaccataagccctgagaagtttatatttttacagtctcataatataaattttttaaaactttttttgtttaaaacctttaaaggtttgctgtcttatttgcttcttgtgtctttttcagaatacctttcttaacagtccctatttttagtttaatttttcacttctgttttgctaaggctgtaaattggcaatcacgtttaatggagtcttaggaatcagtacactaagttaaggacctcacaggctttcaacataagctccaacatcaacaacatcccatcattttggttagctcactgccttgttcttggctatattccagagaggtcagaaattattgattcctatgcaacctgaattttgtcagatgtaaaaaggaatatttaaaatgaaaattgaatgtatttagatatagccacttttttttttttttttttttttgagatggggtcttgctctgtcacccaggctggagtacagtggcgcgatctcggctcactgcaagctccgcctcctgggttcatgccattctcctgcctcagcctccccagcagctgggacaacaggcgcacaccgccacacccggctaattttttgtatttttagtagagacagggtttcaccatgttagccaggatggtctcgatctcctgacctcgtgatccgcccgcctccgcctcccaaagtgctgggattacaggcatgagccaccgctcctggctagatataatcactttttattttccagttttttttaattatatgtttcccttagggtgagtcagatgtcatttattttcgagatccattcagaatgataaattggatacaattgtgaggttaattatttcaatgttttgaagatagctcagtcctttttttgtcatctgaggttttgggccctctgaaaaactaccagttggcaagccctctgctatagcatcacaaatgcaaccattgccattgtacttgtcattcttgccctattttgtgttaaaaaaaatatatatatataaacaccatttaggattaacatttatcttaactcttgatgcaattttcatccatttgctgtcattttcccaaaagaaagagtaatgaaaatttaatttgggaagacataacataatactaatcaaatattgtctatataacctatatatcaatcagatcattcctgattttatcttatgagttggaattttaacctcttacatgtttgaacaattgttattagaacaattgttgctagagaacagatttcctattgccagaaccttcagacagagagaatgtgtgcgcgtccacaagcttaaaattttacgtcagtgtttcaaaatgtttcttgaccatggggtattaattctgagtggtattatgagcggtaaaaagtaaaaccctgatagtttcctggatcagacctattagagttgtttagataacacactttgaattacttcctctcaggaaacattgaaactggaaatgttaaccagacacacatacggaagcacttagaatgcattgtttcttttgctattaaaaaaaaaaggaaaaaaattatgcaaataaattacatctgtagaaacctgaggagactatttggctctactgctaaagaaagagcatttatttatgagatttttcatctgtcactggcagtgaccacaaaattggtcagtacgttagttgtataatttattcagggctaattgctagcattaataatgacttcagagttggaagcatgggatacagattgtgctcacatatgttacacatttttatgtatgagagtaggagtaagttatttaagaagtacacacatacacgaaaatgtagacaaaactgttgaatgtgcccagatagtgacatttagtaaggagaactttgatctgtttaatctgtacgtgtactgtttgatatgagtctcaaaaactggtggacattatctttcagttcatttcctgtgcagtacttcactagacttatcatttcttaattctggaaggtgtatgtttataaagataaattaggaaaaatatagtaaatattgatttaaagggatagaaacacattttttgtttccggatccctgtctgcatcttatccctgtctccatctttattcaaatgggtgactcgccaagtttttcacaaagttctaataaaaaggaagtatagcagtgcagctgagagttttgcagactagactattctaaaattgtatattttgaattatttccatatgttcacatcctttgggatataattgtaatgatatttcaggctctattctggcattaagttttattctgggataacatagtcaataaaaatttgaacgatattcagtacagagaaggataatacttagaagtagtggtttgggcttcaacacagtaggagatgaaaacttagaaatctatgtgaaaatacagaggtgtgaaaggcaatgtgaaacacttaaaaaaagtaaaatgttttgttaataaaagtaatagtaacgatggcctccatttattgagagcctaccatgtgccaagcactgtgagcatttgtttacatacgttcacttagcctgcaaaatagatggtgatgttccattttataggtgaggaacctaaggctcaaaaaactaaaagcattttgtctgaagtcactacactgtaaaggcaagattgaaactcagcttgtagtttagctgatagtattgtatctgtcagtttccaaaggccatggttcttttcatccatctatacccagtatcagtaaacctttactgtaagaaacagagagcacgtattttagagtttgcaagccatacagtcactgttgcagctactcagcactgccatcatagcgtgaaaacagccatagactatttataaatgaatgggtgtggcagtgtcccaataaaactttatttacagaaccaagtggtgggccaggtgtggactgtgggtattagtttgctgacctttgatctatatttttgtaagtttaactagatgctggttgaaagtaaaagccttagggataaaccaaaggctaaaattgatagcagatgattcttggtgacctaagtcaagagaataaaataactgaaaccaggacccagacagagcagcctgttcctctagtcccagccacttgggaggctgagacaggaggatcncttgagcctaggagttcaagtacagcttgancagcatagcaagacccagtctcttn

SEQ ID NO: 67853 - DNA, 1741 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgaaaaaaaaaaaa

SEQ ID NO: 67854 - DNA, 1062 bp, Homo sapiens
  misc_feature (998)..(998): n is a, c, g, or t
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaggtttggtagactggtgcgtacaaagtgtggcaggtctaacaacacggccccacctcggacgccccgctattaaangaacctatctatgtcgcacgctccccacaacctacgtcgagatcacacagtagggcaccagcac

SEQ ID NO: 67855 - DNA, 1089 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtaaaaagttatttttcatctttttaaaacctagtgcatcttttgcataagtggaaaagccagctcccatctatttaagaattctacatctctttccccttcagaaattgtgctgcttctggccgggcatgtggctcacgcctgtaatcccagcactttgggaggccgaggcaggcagttgacttgaggtcaggagtttgagaccagcctgaccaacatggagaaaccccatctctactaaaaataaaaaattagccgggcatggtagcacatgcctgtgatcccagctactcgggaggctgaggcaggagaatcgcttgaacccgggagacggaagttgtggtgag

SEQ ID NO: 67856 - DNA, 763 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattggggatggaggttagggaatggagatttcctctaatgattcaaggctgtgcacgttgctccttaggaactcaaattgaggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaacaagttagttttttgtacaaacatgtttttatagtccattctggccctcaatatgattgtacttgtccctgaaatgtgtttatcttgtcctttatgtataaagtatgtagactgatgtgccac

SEQ ID NO: 67857 - DNA, 166 bp, Homo sapiens
catcacactctagagtcataaagtgataaacctgaataaagtgtagagtgcttatttaaggaaaagcctgctataaactccttaggaactcaaattgaggtaggtaatttcaccctcttttggtcagaatgagtttatagcaggcttttccttaaataagcactct

SEQ ID NO: 67858 - DNA, 1688 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaaacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgaaaaaaaaaaaa

SEQ ID NO: 67859 - DNA, 1547 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccgttacagtatctttgttcagctggattctgggttggtattggtcatatgttagtacgtgc

SEQ ID NO: 67860 - DNA, 1687 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttatttgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgaaaaaaaaaaaa

SEQ ID NO: 67861 - DNA, 2377 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggtgaggggtcctctcgggcagagtggcgacaggggtgcggaggtcgagggacagcaagtcggcgacggcagaggggcctaaagggttccctgggtggttggccaccgagtccattgcggcctccgttgttcattgcctctttccaccaagtctgagggatgagcttgggccgacttcgtctctgtcttctccgagacatggccgtcgcttttttttcattgtcattattaatgatttggatctcgcagctctctatccgggtcctcagtggcgcgagggttgccgggatagcactttctcctgttcctcattctcccggtcctttatccctccgccgggtaccctttcccctgcccccctcccaccgcctcggcaacaaagcttattgtttctacccactttacgcctgcgcgtcgccacgcgcagcccctacttgctgcgcgtgcgcgcctcagccgaggctggggtttggggagagaggggcggagggactggcgggctcttggcgtcttgggggaacgctgcaaccgtcgacgggcctgatcagaagatcgtctttctcccgtttcttcgccatcgctaccccttatttttggttgtattgcagctcatgccctggaaaaaagaacctttggggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgaaaaaaaaaaaa

SEQ ID NO: 67862 - DNA, 1237 bp, Homo sapiens
atcctgcggcgtactagaggaccccccaagatgagaaattgagagaatcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgaaaaaaaaaaaa

SEQ ID NO: 67863 - DNA, 1716 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgaaaaaaaaaaaa

SEQ ID NO: 67864 - DNA, 851 bp, Homo sapiens
cggacgcgtggggtaaaaagctgtcaaacatttacttagtaacagtctcagcacttttattaagcatgcaagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgaaaaaaaaaaaa

SEQ ID NO: 67865 - DNA, 746 bp, Homo sapiens
aaaaacagtccagacgtttgtttcatcaggacaccaaactctaaaaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgaaaaaaaaaaaa

SEQ ID NO: 67866 - DNA, 666 bp, Homo sapiens
ggccaacgttggtctcagctacaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgaaaaaaaaaaaa

SEQ ID NO: 67867 - DNA, 1744 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggtgaggggtcctctcgggcagagtggcgacaggggtgcggaggtcgagggacagcaagtcggcgacggcagaggggcctaaagggttccctgggtggttggccaccgagtccattgcggcctccgttgttcattgcctctttccaccaagtctgagggatgagcttgggccgacttcgtctctgtcttctccgagacatggccgtcgcttttttttcattgtcattattaatgatttggatctcgcagctctctatccgggtcctcagtggcgcgagggttgccgggatagcactttctcctgttcctcattctcccggtcctttatccctccgccgggtaccctttcccctgcccccctcccaccgcctcggcaacaaagcttattgtttctacccactttacgcctgcgcgtcgccacgcgcagcccctacttgctgcgcgtgcgcgcctcagccgaggctggggtttggggagagaggggcggagggactggcgggctcttggcgtcttgggggaacgctgcaaccgtcgacgggcctgatcagaagatcgtctttctcccgtttcttcgccatcgctaccccttatttttggttgtattgcagctcatgccctggaaaaaagaacctttggggtactgggaacccttaccctaggagggcgttgagttagatgaactttaaggtcctcttaccttttaataattttctgtgcttactctcctccttccccaccatcgccaccagaaataaataaggcttgtggtgaacttaggtcttcaaaacatttgttgcagcagccagcagtgatattttttagggactcctaaaaggggtcttacctgcttccttttgtttcttttttccctgatttggcacccgtatcaactcataaaaaccccaaactctagaaagaatttggcttccaatttgccttggaaggtgtagcagctgacagcctttgacgtttatttcaacggaaagtagatgttcatgttgggtgtgctggctaatgttgaaacgtggtggcattgttttttcacagatttcattagcacagttagatcaggtgttggtttatattttcattaagtcgcttttgaaatttcttctggcgtaggttgtgtttgcaataagtaaaagttctctacaataatttttaatgagactccactatttgcttttgtgattctgtttccagttagtgaaagacaggatatttggggaaaattagtctgtttatactacttgtcagttgtgaacttgaataaaactttttcacacacacacaaaatcacaggataggtaacttgacaagaactatagaacccacttgtgtttcttt

SEQ ID NO: 67868 - DNA, 253 bp, Homo sapiens
tagtgtttaatttggtgcttgttcacaacttgactggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgaaaaaaaaaaaa

SEQ ID NO: 67869 - DNA, 1231 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatctgtacatatattattttgatgtattaagagaatattgctgatttaaatttattatgcacacttcgatcgtccgcctat

SEQ ID NO: 67870 - DNA, 1163 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggtgaggggtcctctcgggcagagtggcgacaggggtgcggaggtcgagggacagcaagtcggcgacggcagaggggcctaaagggttccctgggtggttggccaccgagtccattgcggcctccgttgttcattgcctctttccaccaagtctgagggatgagcttgggccgacttcgtctctgtcttctccgagacatggccgtcgcttttttttcattgtcattattaatgatttggatctcgcagctctctatccgggtcctcagtggcgcgagggttgccgggatagcactttctcctgttcctcattctcccggtcctttatccctccgccgggtaccctttcccctgcccccctcccaccgcctcggcaacaaagcttattgtttctacccactttacgcctgcgcgtcgccacgcgcagcccctacttgctgcgcgtgcgcgcctcagccgaggctggggtttggggagagaggggcggagggactggcgggctcttggcgtcttgggggaacgctgcaaccgtcgacgggcctgatcagaagatcgtctttctcccgtttcttcgccatcgctaccccttatttttggttgtattgcagctcatgccctggaaaaaagaacctttggggtactgggaacccttaccctaggagggcgttgagttagatgaactttaaggtcctcttaccttttaataattttctgtgcttactctcctccttccccaccatcgccaccagaaataaataaggcttgt

SEQ ID NO: 67871 - DNA, 1733 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaatagttttaagtagtcctgaaaa

SEQ ID NO: 67872 - DNA, 1606 bp, Homo sapiens
  misc_feature (1591)..(1595): n is a, c, g, or t
  misc_feature (1599)..(1599): n is a, c, g, or t
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaactgttctagctttgttaaaannnnngagngcacgag

SEQ ID NO: 67873 - DNA, 1687 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgatcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgaaaaaaaaaaaa

SEQ ID NO: 67874 - DNA, 1818 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattggggatggaggttagggaatggagatttcctctaatgattcaaggctgtgcacgttgctccttaggaactcaaattgaggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacattatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgaaaaaaaaaaaa

SEQ ID NO: 67875 - DNA, 816 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagcgacgtcggatgaacacgtcgga

SEQ ID NO: 67876 - DNA, 642 bp, Homo sapiens
ctcggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggagagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatggcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactgaaaaaaaaaaaa

SEQ ID NO: 67877 - DNA, 653 bp, Homo sapiens
gagcccagttaacaagaacaaaaagttgtttgtatattacagcaaactcacctgtgtatttgtatctttatataagcccagataacagtaaataaagagagcgcagagaatatttactggacagttttatatggctcataaaaagaaaccatctgctttgatcctcccaagaggatttttgctacctaaaaatgcagctgtcctgcttcttgaacagaaatgggtacatcttttctcccacaagaagagtaatagaaaatagattaatactctgggcttttgataatgggtaagcatactgaaatccatctctcaactttcttgtcccaaccccaacacagggacaattccttgggtatgcagttaagtaggccaccctgataaaagattccgtttgggtttatggtagcccttatatattaatgcagcacaagctcctggaaatgcattcaagttttaaggtccagcgttttaagtcaccagaacaggaaaaaaaaaaaaaaaaaagtctgttttcccccctccactgggctcctcctttgacttagaggccccagggagtacaacatggccagctgcattgccattcaatgagtgacacttagaagagaacctctgcataatgcgtgcctcccaagagaatacaggacagg

SEQ ID NO: 67878 - DNA, 449 bp, Homo sapiens
ttcctaggataactcaccaaaatgttctgattctgaattttcttgcttctagaataaggataataggatgtctgtttcacagatatatcctattaactgagtttaaattagattgtgtgtgtgactatacttaacttcaattttaacattaaaaatgtcatcctggccgggcgcggtggctcatgcctataatcccaacactttgtgggaggccgaggcaggtggattacaaggtcgggagatggagaccatcctggccaatacagtaaaaccccatctctactaaaaaaatacaaaaaattagccaggcatggtggcacgtgcctgtagctccagcaacttggaaggctgaggctggataatcgcttgaacctgggaggcagaggttgcagtgacccaagattgcgctactgtactccagcctgggtgacagagcgagactccatcta

SEQ ID NO: 67879 - DNA, 335 bp, Homo sapiens
gtgatccatccgcctcggcctccaaaagtgctgagattacagatgtgagccaccacgcatggcccaaggagaacgatattactccccatatcccagggggtgtatatccccctgtgatatggttcagaatatccggaaggaaagacagggatattacttcccatatcgcaaggggtgtgacatggttcgtaatatcccatgggggagagggtaatattactcttcgtattgtgaagggcatacactcccctgtgatacagttcataatattccggggagtagaggaagatattatgctccatatcgcgggtggcataagccccctgtggtttggt

SEQ ID NO: 67880 - DNA, 175 bp, Homo sapiens
ttttcctcatgttattatctggctagaagcttcggttttaattgtgattaaaaacatgatagtgagcaaacgtatcccatttgtgattttacatggaatgtttttagattttcatcaagaatgatgtttactgaggttttggctgataacatcattcatgtaaagagaattctct

SEQ ID NO: 67881 - DNA, 440 bp, Homo sapiens
gaaattagtgattctgccacttttcagttgtatcacttcgggcattcacttcatctctctgagccttaaatttctcatctatatgttgtggatagtcatgcctgtcttgactgcttggccaaataaaaactcaagttttaaattctgaaaccttagggttcaagagctggggagggagtttacatgttttctaatggagccattatctgttggaggcattcattcccctcaccagcatcctagacaaataccatcctcttgattcagttggaatgctgacatgcctgtggagctgccctcgggagatctgattgttagaaacgtcttcctatgccctctagtaacttttatctgtttcgcctctggactcaacaataaatttcattcctaaactgttacgcatattgacaaatactgtaaaaatatcatcactttaaaaa

SEQ ID NO: 67882 - DNA, 331 bp, Homo sapiens
aggttatttaagacaacaactagacaatggttattcttttcctgaaggtatgagcaaaacaaatttagaccctttcctctgattctcagtccatcccccgccaaacaatgacacagtttggcatatgacttctccaccactcttgagtgattgaactggaaagggtgctatgatcttcctgacagcgacctgcaaggagggagctctgttagtgccaccctcatccctcaggtgcgcttcataggcaaggctcactgctctcaagagacaactatgtaccctaagtgagtagcataacacataccatatgcattatttcattcactaagta

SEQ ID NO: 67883 - DNA, 310 bp, Homo sapiens
atttttttaatctaaaaatatagtttactgctgatatggtttgcctttgtgcctccacccaaatctcatctcaaattataatcccacatggagggagggacctggtgggaggtgactggatcataggggtggctccccccatgctgttctcaggatactgagttcttgcaagatctgatgctttaaaagtggcaaatgcaaattcctttggggaaaaacacttcaacccaggccttaagaaatccaaagtgcgatttctcatgaacaatccccaataaacactcaaagtcaacagcacagagaaacaagg

SEQ ID NO: 67884 - DNA, 396 bp, Homo sapiens
ataattttaattgtttcacatcgtatgttcccattcataagtgggaactaagctatgaggaatgacacaatggactttggggactggggggaaagggaaggagggagctgaaggataaaagactacacattgggtacagtgttcactgctcaggtggtgggtgcaccaaaatctcagaaatcaccactagagaacttattcatgtaaccaaacacctcctgttccccaaaaacctattgaaataaaaaaaaatttaagaaactaacaaattgtttgtttcagatgacaaggcagtttccttaacattgagaaattagagtgaaaaaaatgtgttagagattatgaccgaatctaataatagctatctatgtggacagtattacaaaaattaaccaa

SEQ ID NO: 67885 - DNA, 386 bp, Homo sapiens
gttaccaagtgttgggacagatatagagtagctgcttctctcgtatacggctgaagtgtaaattggtacaatcactactttgctgtatttattaaagttggtgatatgcacactctaagatcagaaattccatctcaggtttgtacctagcagaaatacatgcatgtatagtgcaggagacatgcaaaaaaaatgctgatagcagcattactcagaaacatcaaaaactagaaataatccaaattttcaaaagaaaaaaaaaagcaggagctgaatatggtggcgcatgctgtcatcccagctacttaggaggctgaggcaggagaactgcttgagtccaggagtttgagtccaccctgggcaacatggtgagatcatgtctctta

SEQ ID NO: 67886 - DNA, 433 bp, Homo sapiens
cgtgaccacccggaactggcgctggcccgagcgctgcgcgcagccccggttcccgcctgcgtttctcccgccacacctcccctcaagcagagggagccggttccgacctaggcctgcccagagaggggccccttcagcgcagtggtgggctgaagagctccttgagcatggccagagtgaacgcccatgccgaggaggcgctgagagcgagggagggctgctagcacgttgtcacctctcagaaggacatgaggaaaatatcttcctacaatgccccatgttccatctctgttgatgtttggttggagtaatgtagatggtcaccaaatatgttgcactattgattttcaacggaagagctccacagtgctattatctatccaacaaaaaggtggagtcacagagctatctgctgctcctaatattggagagc

SEQ ID NO: 67887 - DNA, 179 bp, Homo sapiens
attaatataaagaagctatatctatagaaaaaaatgtgaatgggcaactgaatttcatgaattatcaagaacaaatattatgtatgatgacataatgggaagttaggatttgcctcacaacttggttatgagaaattctataacctgttagaagagattaacacaaatcattaatggtt

SEQ ID NO: 67888 - DNA, 609 bp, Homo sapiens
cagtaccccttcacctttatatgctgtaaatctttgtaatgaatactctattaatgatatagatgactgaattgttggtaactatagtgtagtctagtgaagatgaattgtgtgagttgtatattttactgcattttagttttgaaaatgacttccccaccacctagaaacagctgaaatttgacttccttgggagaacactagcattaatgcaagtaagactgattttcccctaagtcttgttatatttgataaggagcattaatccccctggaaatagattagtaggatttcctaatgttgtgtagcaaacctatacttttttgtatttaaaaattaatgtgaaatatgcatcatacacaatattcaatctagattccagtccatggggggatttttcctaataggaattcagggtctaaacgtgtgtatattttggctcttctgtaaatctaatgttgtgatttttatatttgtttcgttttgtctgtgaactgaataatttatacaagaacacactccattgagaaacgttttgttttttgctcgtttgtatcgtctgtgtataacaagtaaaataaacctggtaaaaacgctaaaaaaaaaaat

SEQ ID NO: 67889 - DNA, 327 bp, Homo sapiens
gtttcgccgttttggccaggctggtttcaaactcctgacctcaggtgatccatcctccttggcctctcaaagtgctgggattacaggtgtgagccaccacacccgaccctctacaaactttatttctaacatctcagccattgacacgtaaaccacattatgccacacactttctagacacctataaatgaatcttaccaaagttccaactaaaagaattgctggttctaatagagacacatagcattacatgagctaaaatggaaaaagaaactttagaaaaagcaaacaatctttctactgttacctttgtccattaagatccag

SEQ ID NO: 67890 - DNA, 441 bp, Homo sapiens
agctaatttttgtacttttagtagagacggggtttcactatgctggccaggctggtctggaactccccacctcaagcaatctgcccacctcggcctcccaaagtgttgggattataggcatgagccaccgcgcctggcctaaaaaaaaaaaaaaaaatctttttttataaaaaatttgattcatagtttttttaaatacaacgagtacattgaacatgcttcacattcagaacatgaagtcttttaaatgaatataggtagaacttccaacttccaggctttgtaacagaaatcatattaaagactcagtagcaagcctaatcctcaaatcccccatctgttaacctgataatcctcatgtgtaaacttatttaagaagctaactcctgagccacctgtattctgagcattgcaataaagatgtgaagattttaatattac

SEQ ID NO: 67891 - DNA, 406 bp, Homo sapiens
gataggacctactactctgtaatcatccatgggcaacagacaagggctgtcagaggacccaacagacggaagccagtgctagaagacagaactagtttcctcaaaaaaaaaaatcagtcaaagccaggaacggtgtggctcatgctgtcatcccagcactttgggagcctgaggcaggaggatcacttgaggccaggagttcaagaccagcctgggcaacacagggagaccctagaaaaaaattaaaagttgttttaattgaaaacaaatcagtcaaacaaattactggtatgctttaaaaataactgtgtgacagaagaattacttgaacccaggaggcggaggctgcagtgagctaagatcacaccactgcacaccagcctaggtgacagagtaagactccgcc

SEQ ID NO: 67892 - DNA, 884 bp, Homo sapiens
cagaccagagcgtgccatgtgaaatttcagaacaccacagatgaagtaaggaagaccagaaaggttccaagagggaaaaagcagccacatataaagtgtgaaaaatggaattgctttgcacccttccacagcaacattggaagctaaaagaaatggaagcattgccttcaaaactcagggtgaaataattcttcaacctaaaattctaaacttagccaaactgtaagtgtgcaagtaaaggctgaataccaacagatgtgcaagaaagaggaggaagccaagattatctttctcagagacttcttagaaatgtactttcttagaaagtttaggaggatatacttcaccaggacaagggcatgatcccagaaagaggaaaatgaagccagcaggaagatccagctcagaatggcacaggtctagagggacagtgagggaagactaagacagcagtcagtatgtgatggcactgcccttccaggaggaccaggggaacaagtgaggggctctgtaagagctcacgactctgtcagagcggggaagaaacagctctgaaattcagtttcctaaaccttttgtagaaatgagaagaaagaaactgtaagatccatgagtgtaagggtttttgagttttctgtttgtttcccctgtgcccagaatagtgtctagcacacaggggcgcagtatgtgctcttttaatgacttaattaaaggaaacccagttaccagaaagagagaactcacctcgcttgtggagagtagggctcccagagaggagtgaggcaggagatggctgtgtttaatttagagacttttcgtgacatttcactttaaaactatccacatgtattatattggttaaattacttttgtaagaaaatgtg

SEQ ID NO: 67893 - DNA, 747 bp, Homo sapiens
ctatctaccagctccaatgagcttgctgaggatgggtatgaccccagtctaaggggaaagaatctaaaacacaagtaaacctgtttaaaggccagatctccagatggagatccaagcagatggcgcctaaggtttgcccttgaaaactaccaaggaagccacagagagggatctttggaccttctggaaaatggtaaggccccaggtagattatggctcctctgccctggaggctgagccgcccctctggttacctcacatcttctggtttcttctgagtgggacttgatctcatttctgcattcacagcaaggtggaactgtctggcaagagcttaaattaggacctgtggtggggactttaataggcaggtggaggtttgagatccagtgagatgccagagattagtcaataggtgaggaaagatttggcccaaatcaaaagagctaaaaaaaaaataataaaataaaaataaaaataaaatagttgaacaaataaggttcatgaaaaaaaaagaaaagaaagaaaaggtaaagaaaagaaatccatgataaaatatcaaactttttaataaaaacaagtctggccctgtacttggatgaccccacctggcttgtctaaccctaatcccagccccagttttaataaaactgtatttacaaaataggcagctgggacgtggaccagagataccaatttgattttttttaaatattacattaaaatattacatcatgtgtcttcaaa

SEQ ID NO: 67894 - DNA, 242 bp, Homo sapiens
acgactggctgatttttaaatttttttgtagagattgagtaccaaccactatgttgcctagtcttatcttgaactcctggcctcaagcattgtctcacctcagcctcccaaagtgttgggattacatgcatgaaccgtcacaccagagtagaaatacagttgttgacagtttttttcctggtttgtgtctgcatattatgaaatactcttttcagtgcctataaatattttaagtttgaacc

SEQ ID NO: 67895 - DNA, 262 bp, Homo sapiens
ttttctccataattatatgtttttattatcataggaaaaataaatgaccaagaaattaggtttaccaatgcagtgaactggtaattttatttttaatgtatatattaaatcctaaatgcaaacctctattacgttgtgttattttataccttacattgttttgaaaggaattgaggtatcttttgaccaggtcagagaaccatttcagtatattcaaaataatatgaacaatatgaactcagaaaacacttggccagataac

SEQ ID NO: 67896 - DNA, 2534 bp, Homo sapiens
  misc_feature (276)..(276): n is a, c, g, or t
  misc_feature (1299)..(1299): n is a, c, g, or t
  misc_feature (1383)..(1383): n is a, c, g, or t
  misc_feature (1767)..(1767): n is a, c, g, or t
  misc_feature (2511)..(2511): n is a, c, g, or t
gtggggtcggggggttggttgggtgcagtaccccgggcgttcactgcctgtgacaggagcagattgggggcgctatctggggctgtgctgcttgtggtccgggtggggggcgggtttgatggggcactatttggtgctgcaacacccgtggcagggatgggttgtggacactatcgagtgtccaccacgggtggtttgggggtgctatcagggtaacactgcctgcagcagtctctgggtgtgttgtgggcacaatctgggggctaagcttgtggngagggggggcaggttaggggtggtatggggggaggctgcactgctgctgccagcagcaggttgtggaggtggccatgacagtggtggcctctgaggaaggggcccttctcctcttcctggactcaaggttctagagggtgaacaacttctgctcgtgttggagcgcagagggtgcacagagttttcacggcaatcctctgaccactgcagggccttcgcacccaccatggttacccggcccttgccctcttgctctgtgttgtggagaccatctgggagccccaggcatggagtagtgggcaccacgggggctcagggtcctgtgggtggaggagtcaggaatgggaactggtacttgggtggggaggactggctgggtctgagtttctgctattcttgctccccagggagccccgggcactgtggtgtctccagtccccaccccaggtcaggaggccagcttggtctaggaggagaggctggactttggagggtgggtgtgagagccttcgccaaaactggccccagccacccagtggccagcatgacaaggtgaggctctaacactgtcactttctgcatcctgttgtaggtttttctggcattgtctgcccagctgctccaagccaggctgatgaaggaggtgtcccctgtggtgagctggaggttggagcctgaatatggcacagctctgtgattcatctcctatggttgtggcagccatggtgatggagacggcagctcaacaggagcggtaggagggtacctgtggaggccaagtggtaggagccttggagggtgggcaggtgcatggagggtgacagcagcgctggttcctttggcgtcagtgctaatggtggcagcagcagcaagtctaggggccaggaagggggagtaggagggctttggggcctggcccagcctgggatgtgtaagaagctgctggttctgtaccacaggcctcagtgatggtggaggtgcagccagggcaaggaggagtcctcccccttctcctgcagtctntggagggtgccctccttctgctggcatctgagccaggtgtgagtggcagcattgttttgttcttaacagaatttaggggcttangatttgtgtatctttttgtttttggttgtgataaaccttaagggacaaaaggcttctttcctgggttttggtgttgtgggatccccccatgtaagataaagggtgctttcttggcaagctgtgtgttggagggagttcaccaaggggaagaaagggaacctctcaggagggtggctgctgtggcaggtcccctgcctctgggcaccctttgggccacctagtttcccctgtggaagaggggaggcttagaccagtaccacttgtatcatcaaagaggcatcctcctgggccagttgatttgaccttcccacttcttcagcccacctgcccatggtgtcacctggggaaagtggaaccttaggccacaggggcagaggcttctcnggcaggctgattgctgtagcagattctgttctgcctgctgctcaggagggcttctatggccaggaagtgatgctgggactcttctgttggtgttctgctgcctccgtgttgtctctggcttctcacggactctcagatgtgtgaaggcaaaaaggtttcctggctagtttgcgtggtgtggttgggatcacttttgctacatgcctctcaggcaccctagtgggggaaaagggaattttagatttaaggagaatgtgtctatgttggctgcttattgttagcaaatttctgaacaattctattctaaatggtcgcctcttgttgagtagactccagctccattggagaagagatgagcttacctgggctgtgttttcttgctagcttgagggttgaaaacactaggattttgtctccttttccagttgagttagggaagtgacatgcattgccacaaaacaatttcttcagttctggagtccttagacagtcatcttactagcaccttccagcattctcctttcagtgagataataagggagggttcctaatctaaaaggaaacatggatggtgttcttatgttgtatgacaagaaatatgaaataattctgaaaaatttagtcattcttcttttaaatttagaaacccgttttttatatttataatatttaaagccattaaaagttaagatgtcataattaaaataatcttttaacattaattagcatttagcagatgaccanaataaattatttttaattatgct

SEQ ID NO: 67897 - DNA, 189 bp, Homo sapiens
tgcggccgcgtcgacccaactatccaagtgttattgggggttttagttgatacaaacaatgcaaccaactatccaagtgttataccaactaaaacccccaataaaccttgaacagtgggttgcattgtttgtatgtagatctttttacattatatggtaatgtacactactgatatagttcacagtcga

SEQ ID NO: 67898 - DNA, 1662 bp, Homo sapiens
gtgctgcagccgctgccgccgattccggatctcattgccacgcgcccccgacgaccgcccgacgtgcattcccgattccttttggttccaagtccaatatggcaactctaaaggatcagctgatttataatcttctaaaggaagaacagaccccccagaataagattacagttgttggggttggtgctgttggcatggcctgtgccatcagtatcttaatgaaggacttggcagatgaacttgctcttgttgatgtcatcgaagacaaattgaagggagagatgatggatctccaacatggcagccttttccttagaacaccaaagattgtctctggcaaagactataatgtaactgcaaactccaagctggtcattatcacggctggggcacgtcagcaagagggagaaagccgtcttaatttggtccagcgtaacgtgaacatatttaaattcatcattcctaatgttgtaaaatacagcccgaactgcaagttgcttattgtttcaaatccagtggatatcttgacctacgtggcttggaagataagtggttttcccaaaaaccgtgttattggaagtggttgcaatctggattcagcccgattccgttacctgatgggggaaaggctgggagttcacccattaagctgtcatgggtgggtccttggggaacatggagattccagtgtgcctgtatggagtggaatgaatgttgctggtgtctctctgaagactctgcacccagatttagggactgataaagataaggaacagtggaaagaggttcacaagcaggtggttgagagtgcttatgaggtgatcaaactcaaaggctacacatcctgggctattggactctctgtagcagatttggcagagagtataatgaagaatcttaggcgggtgcacccagtttccaccatgattaagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtg

SEQ ID NO: 67899 - DNA, 581 bp, Homo sapiens
  misc_feature (518)..(518): n is a, c, g, or t
  misc_feature (559)..(559): n is a, c, g, or t
  misc_feature (565)..(565): n is a, c, g, or t
tgactgggaatcaaacctgggctgcagtcatgaaagcagaatcttagctggtagaccacagagtggagtgcttttttgtaaatccttcaggagatccaagcaggcagtttgagcatataaaggatttcaactcatttcagatctgatcacagctggaatgctgtttagctaatttcctgcatgttaatatttcaaagatatgatgagatttgtatctgcaagggattgtgaagtccagcagggcatttgaaggatattgtctgggccggcctcgcttcccaaagtgctgggataacaggcatgagccaccgcgtctggccatatctagtcatttaaattacatacgataactacaattttaactcttaggaacgctaatttacagtgaaatctggaggaagtaattttggagctgttttatgccagtatttataggatggaaaaccatttccataatttttataaaggtggttccctcaattattttggtttattaacaggatctaaatataatttangctttccaacaccctttaactccggccatttatggggtacnccatgncttaatttacctgggc

SEQ ID NO: 67900 - DNA, 734 bp, Homo sapiens
tggagaccatgcgcaggcgcggtgcactgtgcgcgggcaccacggcggtttttcgacgctggcggtggacgcaggcagcatggaccacggttgctgggcggatggggagcgtctatggtcagttgccttagaagtggtgagatgggaagctgcagttggaagaccctggaggatgcctgacaaggggatgtctgacacatgattggagctctttttgaaatgtttcttgcccttcctggagcagaggagccattatttatgcaggtacatcgaagtcttttgacctccatacagtgattatgcctgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggtgggcacaaaaatcttcatgagcaatacttcttagtagattgttttgttattcaaatcaagttctagtgtttttatgtgagattatataatttacagtgttgttttatatacttttgaataaatgtacactattaaaaa

SEQ ID NO: 67901 - DNA, 704 bp, Homo sapiens
tggagaccatgcgcaggcgcggtgcactgtgcgcgggcaccacggcggtttttcgacgctggcggtggacgcaggcagcatggaccacggttgctgggcggatggggagcgtctatggtcagttgccttagaagtggtgagatgggaagctgcagttggaagaccctggaggatgcctgacaaggggatgtctgacacatgattggagctctttttgaaatgtttcttgcccttcctggagcagaggagccattatttatgcagtgattatgcctgtcatcgctggtggtatcctggcggccttgctcctgctgatagttgtcgtgctctgtctttacttcaaaatacacaacgcgctaaaagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggtgggcacaaaaatcttcatgagcaatacttcttagtagattgttttgttattcaaatcaagttctagtgtttttatgtgagattatataatttacagtgttgttttatatacttttgaataaatgtacactattaaaaa

SEQ ID NO: 67902 - DNA, 1080 bp, Homo sapiens
gtgtcagcgctgcttggctgtcactggacctcactaagtttaccatcaggtgtttaattcagcaccttggccaagactccctctgtcctgggcactgtaggctgcagattctgtgggggaggctgcatgaacgagctctgccttgtgctcatgtggaggacgggctggattgatctcttcttgcctgaattgggagctctcaggatattcctccatttgtttctggaggccttggggaaaatgactggggctctagatctcagggacagctgaaccgtgtgaaaaacctggggaacagtggacaagggagggtaggtcagataagattgcattttggggagaagaccctttaagtaccagagagattggttgtcagatgcaattgtgtccccattctaaggagttcacaatggcacatcccggagcctgggacacagccaaatgcagcaccttcccatcattcctgcatctcgggggcctgcagtgaccagttgggtgaccttgcttgcaaaatcactcactcttgcttttgtaacctcagtttacatttatagcaatcatagaagaggaaaggattcgagaggaacttgggatgggggagagagctttaatgtagggctggtgttcatgtttgactggcttcagcactaaactccccagataccccccaacagttctaacaaaagggctgagaagaaaaattctaagcctgtgctttgtgtgtgtcttttctcaagagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggtgggcacaaaaatcttcatgagcaatacttcttagtagattgttttgttattcaaatcaagttctagtgtttttatgtgagattatataatttacagtgttgttttatatacttttgaataaatgtacactattaaaaa

SEQ ID NO: 67903 - DNA, 607 bp, Homo sapiens
tggagaccatgcgcaggcgcggtgcactgtgcgcgggcaccacggcggtttttcgacgctggcggtggacgcaggcagcatggaccacggttgctgggcggatggggagcgtctatggtcagttgccttagaagtggtgagatgggaagctgcagttggaagaccctggaggatgcctgacaaggggatgtctgacacatgattggagctctttttgaaatgtttcttgcccttcctggagcagaggagccattatttatgcagagctgcaaaggaacctgaagctgtggctgtaaaaaatcacaacccagacaaggtgtggtgggccaagaacagccaggccaaaaccattgccacggagtcttgtcctgccctgcagtgctgtgaaggatatagaatgtgtgccagttttgattccctgccaccttgctgttgcgacataaatgagggcctctgagttaggaaaggtgggcacaaaaatcttcatgagcaatacttcttagtagattgttttgttattcaaatcaagttctagtgtttttatgtgagattatataatttacagtgttgttttatatacttttgaataaatgtacactattaaaaa

SEQ ID NO: 67904 - DNA, 1688 bp, Homo sapiens
  misc_feature (1)..(3): n is a, c, g, or t
nnncacatgcgtgcacgtgcacacacacctacacttttgtatatattcaagggatccattgtagctgaaaccaatccaatatctcttccaatattttaccaatcccttctagagattatctagttctaccatctcattttacagatgaggaaattgaggcccaattaagactagaatctagattctcttactcccagtttaatgtccactcaggacttcatcttaagcacttcttcactatagaaagcatgggacaactcacccagagtatacttctttgtctctattcactggctggcttcaaaacaacacaaaagcatctaacttggaggacaatgtcatctggagcatctccagccacttccttcccccactctgatatggtgtgacagaggtacaactggctgggagcctgccttctggccctctccctatgaccaagtagagtgaccactgccagactttagctgatctctatatgtagtcgaccaaatgacctgggaagcatcaaggcaccctcacaactgtgtttccccagagagttttagccagaaaaatacagagtctttggggatttgggcctttgttgttttgaaagtgggaagtaggagaaagaacagggagagaagtaggtagggtgtgaagagaagtataattttatctcatttctttctctgagagatctaagaagtcaagagacacaagagatccagtgtaacttgattttattaatgtttgcattctgtccttcatgtaaccttacgctggagtattggacctggatcaccatcctctctgtcagaattgcgtctcactgatgaacattttcatttcccaggagtggttgatcatgcatcttggcaaatttccctcatttctctttacagtccccattcctgacctttgagaaacagtcatcaaagtgtagaagtaaagtcttttaaaatgcctttccagatggacccttagaactctttcaaagatatttgtaaatattcactctaaatgtaatagaaataaaaagctgtagatcttcattacagaaaaaccattagctcaagattgaagagctcacagtcttaggcacagtttcatcttacgctgtcattatttagatcccaagaaagagagggtgggattggctatcccacagtatagcggggaggagggcagtgcaggaaaggacattgattcctagtaaaagatccattaaaaaacagaaataagaatgaagtaccagaacgtaatttatcatccctttatgctacagaagaaaacttgcaagacagtgtaaggtttccctggaacttgttagaaatgtcatctagacgttgagccaggaacacaatcaagcaacctttcaggatatagccaggccccaagcctcttcagaactgggaataatgttttgaattgaaacagaggtgtaaagcagagaggtcagagcagatcaatactggttatgggtgatgagatccagacagaacagtccccagaaaaataactgtcttacaacgagggggtgtgatggatgtgttattttgttttttttgagtctagtagtattactgtctgaaactggtcagtttttaggggcaacttcaaaatgttatttgtgtctttcttgtaaatacctgccaagattaatacccaatcaaatgccatgacttggaaataaacaaatattc

SEQ ID NO: 67905 - DNA, 1888 bp, Homo sapiens
  misc_feature (1)..(3): n is a, c, g, or t
nnncacatgcgtgcacgtgcacacacacctacacttttgtatatattcaagggatccattgtagctgaaaccaatccaatatctcttccaatattttaccaatcccttctagagattatctagttctaccatctcattttacagatgaggaaattgaggcccaattaagactagaatctagattctcttactcccagtttaatgtccactcaggacttcatcttaagcacttcttcactatagaaagcatgggacaactcacccagagtatacttctttgtctctattcactggctggcttcaaaacaacacaaaagcatctaacttggaggacaatgtcatctggagcatctccagccacttccttcccccactctgatatggtgtgacagaggtacaactggctgggagcctgccttctggccctctccctatgaccaagtagagtgaccactgccagactttagctgatctctatatgtagtcgaccaaatgacctgggaagcatcaaggcaccctcacaactgtgtttccccagagagttttagccagaaaaatacagagtctttggggatttgggcctttgttgttttgaaagtgggaagtaggagaaagaacagggagagaagtaggtagggtgtgaagagaagtataattttatctcatttctttctctgagagatctaagaagtcaagagacacaagagatccagtgtaacttgattttattaatgtttgcattctgtccttcatgtaaccttacgctggagtattggacctggatcaccatcctctctgtcagaattgcgtctcactgatgaacattttcatttcccaggagtggttgatcatgcatcttggcaaatttccctcatttctctttacagtccccattcctgacctttgagaaacagtcatcaaagtgtagaagtaaagtcttttaaaatgcctttccagatggacccttagaactctttcaaagatatttgtaaatattcactctaaatgtaatagaaataaaaagctgtagatcttcattacagaaaaaccattagctcaagattgaagagctcacagtcttaggcacagtttcatcttacgctgtcattatttagatcccaagaaagagagggtgggattggctatcccacagtatagcggggaggagggcagtgcaggaaaggacattgattcctagtaaaagatccattaaaaaacagaaataagaatgaagtaccagaacgtaatttatcatccctttatgctacagaagaaaacttgcaagacagtgtaaggtttccctggaacttgttagaaatgtcatctagacgttgagccaggaacacaatcaagcaacctttcaggatatagccaggccccaagcctcttcagaactgggaataatgttttgaattgaaacagaggtgtaaagcagagaggtcagagcagatcaatactggttatgggtgatgagatccagacagaacagtccccagaaaaataactgtcttacaacgagggggtgtgatggatgtgttattttgttttttttgagtctagtagtattactgtctgaaactggtcagtttttaggggcaacttcaaaatgttatttgtgtctttcttgtaaatacctgccaagattaatacccaatcaaatgccatgacttggaaataaacaaatattcatttcttatctataattaccttttggtgtaatcctttcaacttgtgtaaataggatataacagaataacaccaatagttgttttaagatagactgaaaaacccaaaatgcccatatttaattataactctgacagtagtgtgtttctgagaaaaattgtttataataaacagaaccaagtgtatgaatacatcataggca

SEQ ID NO: 67906 - DNA, 582 bp, Homo sapiens
cgagctatttgctatccaaggaattaaccatggagttgcatgtcatagtagcaattgtgggtttgtttgcaggatcctgtcaagaagacatggtaaacctcatcatgatcaagaatgagactttgcttgcatccaggcattcagttaagaaatgatgttttcccaaccaaggctagcttcccaaaagttgtttgatagtatacaggcatgagatggtgtgactctaactcattagatgccttcgtcttttcagtcatcatgtgatggaaagaaagctatcaacttcattcctgagacttcctgcaacacagctcctgatacacatctggtcagaaccatggtacccctccacaatccacgccaggaaattggatgtctactccctgcctttcttcccattgtttggggacttttccttagttcagctgaagacggggtccttgtcacacggccacgaaaatttaggcttgcagattatttgaaggaaatccaaacaaaagctttagaagaaacacctggaaaaatagtatctccactttgaaaatgcagaaatacaggcataatacaatggtgaaatttatt

SEQ ID NO: 67907 - DNA, 479 bp, Homo sapiens
aaagagctctaggggaacctgagggcttgggtggaagactggagagccaggaggagcaaggagcaggaagcaagtaaagaagccggcccaaacccatcaagaccaagatgatgacatgagtgacctctgattgtcctcactgctacactcccaccagccccctgacggtttacagatgccatggcaacatcaggaagttaccctctatgctctaaaaacgggagacacgtgagttgtttccagttttggtgacgaatgcccaaattcataggcgatgataaataatgtgccagacgttgatgtgcaagttttggtgtgaggtgtggattcattcattcaacaaatatttacggaacgaacacctcctgcgtgccaggctccattccaagcactgggggttgcagcggcgaacaaaacagacccaaatgcctgccctggtgggccaggaaggcagaaataaagatgaagagttggtcaag

SEQ ID NO: 67908 - DNA, 280 bp, Homo sapiens
gtaagtgataaaggatattagtttaattcatttggctatactataactctctggaagaagtagactagttaaatcttataagaggtaagtattttgtgcttgtttataaggatattataagtaatttcaagacaaattgaagatatattatacatgtatgtataaatgcatatgcttatcttcaccttacagatctgtggtatttaggtttgtgaaaataatgcaacttggtgccagttacggaaacatacactgaatgtatgtaagtttttcctcagtg

SEQ ID NO: 67909 - DNA, 395 bp, Homo sapiens
gattgtagggagaatcaaatgacataatggtcatgaaaatatatttctaagttgtaatctgtatatgtaataaggtgttactagtaattgaacatttatatatattctgtaacaggttgtaaacttttaaaagagatctagtacaccaggcttaatggactattttttgaaagacacatcaaaaactgttgacaataattgcctctaggtagagacatgagagtgatgggaaggaggcagacttatttttcactcaatttccttttgtatctcttgaattaatactatatatacacatgacgcatttaatttaaaccaatacaattcaataactatttgagaagttaaagaaaaaagatatatttattctgaataataaattgaaaataatctaa

SEQ ID NO: 67910 - DNA, 2828 bp, Homo sapiens
cccacgcgtccgctcgacaagagcacctgcggagccacgcactgagtgtccacagatccaaccgtccaatcatctgcaagggctgcaggagaacattcacgagtcacctgtcccaggggctgcggcgcttcgggctgtgtgacagctgcacctgcgttacagacacacccgatgatgatgatgatttgatgcccatcaaccttagcttggtggaggcttcatctgaaagccaagaaaagagcgacacagacaatgactggccaatctatgtggagtcgggtgaggaaaatgaccctgctggagatgattctgatgacaaaccacaaattcagcctaacttatcagaccgagagacacttacgtagcaataaattggtggggaagaggaggttttaaaacttgttagtgctcgttctgttgttgaaagataccatttgtccaattttgtggaaccctgagaggaacattttttcactgttattatatgtgcatttttattagactatctgatagaggttggattttgtgactcaaaggacagataacctttttgtgtggtgcccttggtttctgagggctttgctggccactccttaattctgagtgagtcaaagcaggccctgaggtctcctgtttttcttgctgtgtgtccaaactctggttaggagaaagataagaaaatctccaggcttgtttttatattgattcagtcctctgcattcctttgttatcatcctctttctctaaaaaccattaagttttgggatcaagtttacctttgccaagcctttcctaatgaattccacattaaattttctggcaaagtattaaagagaaaccttcattgatataaagcaggcagggcggtctggctacatgatcataaaaggtactccctaaatctagaacaattttaaaggcttggaatacttatgggcagacgaacatgggaatgatctgaaaggctcattatggcatcctgacttgcccagttgaattaaattttaagttagccctgagaagggaggctatgaccccaggtctggatggtttccctgtctggtttggcatttgacgattctacacatacaacctgttctgttatcataaaacaactcatttgggcaaaactcaaaatgctcccctactttttccagcaatttccaaaagctggagctgtgtaacttggaaatgtagctgcctctggcattcttttacttagtttatgctgatgtagggcaggtgagcccaaaaattggggcttagcccagaggagttcttggcttcacccaggaaagaattcaagggcaagccagtggtgttagacagcagcttgtattgaagcagcagtgcccaacagcagctaaggggccgctcctcgtggagcagggctacaccataggcagtgtgcccagagtagtagctcagaggcaggtcggcacttatatttatacccacttttagttacatgcaaattaaggggcagattatgcagcaatatttaggaaaatggtggtaacttccaagccgctgggtggttgccatgataaggggcagtgacttccaggtgttgccatggcaatggtaattgacatggcacagtgataagtgtttcttatggaaatctgcttcctgcaccaccctcccaccaccgccctgttttagctagtcctcaatttggtccatgtccgagtccggcctttggagttgagtcctgccttctacctccttgcctagaactttaattggagggaaagtataagcccataatgccaagtaacatttctaaaatgttcatcttttaaaagatcttcatgagggaaagggaaggttagtagcagaacaggtttttaaaagcagtctacctttcgcccactttccagccacacaattattgtaacaaaagaggctgaactctttaaagggctaaagggcaggcagtgttaggaattcggaatgtaattgaaggcaatttccataattttgtcttatgttaaaatatccaaaatggattttaaaagaaatcttcttgtcttcctttaagtgtagttgtctttcaaaaggtggtaaaagtcacttttatttctacctcttgaacaacaaaaaagtcaaaaacattataaattggcttgtaaatgttagccaaagcattagacaggtgtttaagtcgtacttctcaatagtagttaaaactggaacagtgcaactcaaactctggcccacagagaggccctgttctgtaaactgttttctaccagtctgctacaaggaaagtcagaaattaagaatacacatatagaaatgttgataacactttgacattgctgtgactcatggctttgtcttcttgagtgaggtatggaccagttcagttctggtcagctagagggccacatggtgcagaggttggataccagcctgtacagcaggaccacgtattggtctgcagtagaatggaaaatttaaaacttctcttatcacaggtagttcgataaatatcattcttggctgtgtgcggtggctcacgcctataatcccagcactttgggaggccaaggcagatggaacacttgaggtcaggagttcgataccagcctgaccaacatggcgaaaccccgtctctagcaaaaatacaaaaattagtcaggagtggtggcatgtgcctgtaatcccagctactcaggaggctgtggcgagaggaacacttgagcctggaaaaggttgcagtgagctggaatcgtgccactccactccagcctgggcaacagtgtgagaccttgtctcaaaaaaataataataaaataaataaataaaagaaaaatattcta

SEQ ID NO: 67911 - DNA, 558 bp, Homo sapiens
acagaacagtagggctgacgaaccacgttcagttgcttgaatcccatcatttagtacatcagttccaaacacacagcaagaaacaaagggagagatctgcagttggttgacactgcaggatctggtgccttcagggtggaaggaccacagccctgggtcctgggctatgcaatgttcacaatccgtctctgtctgcccatcagtctcccctgctaacggtgtggttaccaggaccagtcaaatagtcaaacaaggaggcttagcagatggaagctgcccagaaactgcacatccttgtcctaccaaagaaacacaagagcacgatcacctggccagtatctggggctcgccagctgacctgcggagtggctgtgggctttgtttgcatttcttgagcagagcacatatggtcccatctatctttgtcattcatttctcttattttctccagcagaattgaatggtcttaaaagagtgaacatgtattgcagatgccgtgagagctatgatggtgaaactgctgatcttcctagtactttaaaaaagactttctacaaa

SEQ ID NO: 67912 - DNA, 680 bp, Homo sapiens
agatggcagcagtacagtccagcttcggctcggcatcagagggagaccgtggaaagagggggagagggagactgtggggagggagagggagagggagagcctgtttctaataaatatacaaaatcagcaaggcatggtggcacgcacctgtaatcccagctacttgggagggtgcagcaggagaatcgcttgaacccaggaggcagaggttgcagtgagctgagatcgtgctattgcactccagcctgggcaacgagagtgaaactccatctcaaaaaaaaaaaaaacacgaaaataaaacggcatttagagttgaaagcttcgccttcctctctggatggtgagtcctcactctcccagcagcccacacctctgcctcaaacctccatggctcccaagagtctggataaagctaaggagtctcaacgcaccccaagtcctgggggtagtcagcccctctcacccctccctcatcctctcacacaagagttgtttactgttcctccagttatgcctggtcacgcagacactctgctgctcaaatgccctcaccccatcctcagcctgctcccaggccacctccctccagaatccaccctgcctgccaggtggccatagggaccctcgccatactgtctgcttgtggcagtgccctccggcctggggggtcttccagagca

SEQ ID NO: 67913 - DNA, 445 bp, Homo sapiens
ggcagagataggtgggacatcctgggtctctgagcccacctgttacccaacctgccccagtctcccaaaaagacttctgttaggctaactccttactttccagtggcccagagatagatctgagagttggaagtagcaacagcctgaggaacgcgtatcagtgctgggaaatgttttgtcatcattggggaaaattttgttaatactatggctcttatgcttcccactcttcccttcctccatcattagcattttggtcatagcttaatctccctgagtccttaaccttgaaattcatgctcattagaatagagacagagactagagggattttgtcccatatttggttcagttactccttgacttgcatttcccccaaatagtacaactttgtaattaatttctctcccaggacaccaaaacctagcagtagaaatgtgtgtgt

SEQ ID NO: 67914 - DNA, 198 bp, Homo sapiens
taaaaccagtgtttccacaggccagcactgttggcaccgttagcatgcattgttagcataaactgttgcttttcctgatagtcaaaggagggaaatgctaacagaatggataatcaagggaaaagacaagaaaacggacgtaaaatgtacccaaggaattactatgtactgaaataaaattttttttgtttggttttt

SEQ ID NO: 67915 - DNA, 398 bp, Homo sapiens
gttgccagaatcctgttggcttcatttgagatattttgaggttgttggcatcaggcattttgttcattttgtattgatactgagataactttttaaaaagtaatctggaattacacaccctaaatatcaaccatagaaaacattttttcttcttaaggaatggtctctgcagaaatgttttagaacgtattctgaatttttcacaaactcttccttgaatgcctgctgattgaatggatacaggtcgtacaggcaaatacacgctatttccatagtactgagtatattggactaaatctaggcaaaaagctgcctaaaatttatactgtaattggtcagctttatattatggcagccttctcgggggaggaacattgatttctagtgactgccactga

SEQ ID NO: 67916 - DNA, 855 bp, Homo sapiens
gtgctccaagctgatgttatatggaatcctgtgttggtaaatctctgagatgttagtgccggcacggtactgcacaaggaaaggcaaacccacacctgggatgtgggtggatcccagatgagacaaatcactgccctttccaggagagggtgttctgatataatcagcttaccactaggtggctggttgacagccccaaggcatggcaccagatggaagcccagtgttgctgtctgttcattcccggtagataatcgtcagtggtcatgactggatcatgctgctgagaggctcttggccacgatggtcaccctatccagaggtctgctgtgtggacactggggctggtgaggacagaggctagccaatatctgttggtcgacttatcccagtgcttggtttttagtgccccatggtgagcattggtttgcaaaacaaaggcctgtaccccatgcctgttcccaaggcccatctgtctgcctctcacctagaccttgttccctccaggatcctgaccagccgtttgtgcctgcctaggaccctgttatcctcagcacaggcaacttgttttcccccccacacagagctgaccagataccctgcccagggctctgctccacctctgtctttcaggctgttcctatgtgaggctgtagtgaggcctgcaccagtataccaagcaacccatccacaaatcaggtctgcgtttccccctaagttgtagtgaatccccatgaagtgatggcgggagtgaggtgaggacgtcattggtcaacagaggtgcgtgtcatgggggattgggccacatgttgtgtgctgtgtcctctagacatgcttgggttcggtcgtagaggt

SEQ ID NO: 67917 - DNA, 1062 bp, Homo sapiens
agtggctcagtactagaaattaaagaccctttgtgtgaaggtttaagcccatgccacacaggctggagacctgcttcaaagtggatggccttgggaggaattaagatcccgccctattatgggatgcctctgcactgacatttcaattgtgttttcctggttcccggccacttgatctctcctctcctctatctcccacttccccggctccggctcaaacactggtgagtgatgaactgaatggagactgactacattcaactgagtctaccaagccctgcctgagcactgtgatttgattcttggcctccctccctgaggccttgcagccagattagtcaagtctctggagcccaaagcacacacattcctggcttattccttcaggcaaatcatcacttgaggtcgcataagcccctgactatggcagtgccaattataacaagcatggcttgctgacctcctaattgtatgaaaccaattacattatgcttgttgttcattcaacaataagcagcttttgtgcccactaaattgaggcatactactaaatttggtgagtgtaacttggcaatacttctccaactcattaactgcctaaagctttttcaataaagaatacctttgtgcctcttgccttcagagaatgttactttcttgtgtgtattttcctgcccatttcattatatcttacttatgatctttctgcgcaatgtttctccatatgcctcagggcccttatttgcactaaattcttttttctgttctctttttgattcaaaattccagcacaataaaaagaataaagatgtggataaatctaaataagtactgactgcctaaaacaataatagtaaagtattttgggatttataaaatatttagaattaaaatacatgagaataatagcatatatagtttggcaggaagaggaatagagtttaaatattttaaggtccttgaatcacgcaggaagagttaaaagtactaattgatcttaaattttgataagtcatggatgcatgttcaaatgatctgtaggaaaaacaataaaggaatggt

SEQ ID NO: 67918 - DNA, 209 bp, Homo sapiens
tactttgaattctattttattttgggaccttttggttctgttccaagatcttggggttttatcatttaaaagtgaaaagttaactttgtaattgaaatgtcttgcagcttttgcttatacatattccacaattgagtatattattattgttgaggagcttaaagggagcagcctttacttaaaaaatataattgagttagactagacca

SEQ ID NO: 67919 - DNA, 1263 bp, Homo sapiens
  misc_feature (72)..(72): n is a, c, g, or t
catcaccttagctgtatcccagcggttttgataggttgtgtcattactgtcattcgattagaagaatttttnatttctatcttgatttcatttttgactcaatgctcattcaggagcaggttatttaatttccatgtatttgcatggttttgaaggttccttttggagttgatgtccagttttattccactgtggtctgagagtgcttgatataatttcaattttcttaaatttattgaggctcattttatggcctatcatatggtctgtcttggagaaagttccatgtgctgttgaataggatgtgtattctgtggttgttagatgaaatgttgtgtatatatctgttaaatccatttgttccaaggtatagtttaaattcactgtttctttgttgactttctgtcttgatgacctgtctattgctgtcagcggagtattgaagtccccactattattgtgttgctgtctgtcttatttcttaggtttattagtaaatgttttataaatttgggagctccattgttaggtgcatatatgtttaggactgtgatattttcctgttggacaaggccttttaccattatataatgtccctctttgtctcttttaactgctgttgctttaaagtttgtttcgtctgatatgagagtatctaccccagctcgcttttggtgtccatttgcatgaaatgcctttttccacccctttatgtgagtccttgtatgttaggtgagtctactgaagacagcagatagttggttgattagttcttatccattctgcagttctttatcttttaagtggagcatttaggccatttacattcagtgttagtattgaaatgcaaggtactgttgtattcatcatgctttttgttgcctgtgtactttgggtttttgtttgtatgtttgtttttgctttttaacttgtgttttagttttataggtcctgtgtgatttatgctttaaggaagttctgggccaggcacagtggctcacacctgtaatcccagcattttgggaggccaaggtgggcggatcacctgaggtcaggagttcaagaccagcctgcccaacatagtgaaaccctgtctctactaaaaacacaaaaattagctgggcatggtcgtgggcacctgtagtcccagctactcggtaggctgaggcatgagaattgcttgaacctgggaggcagaggttgcagtgagctgagatcatgccactgcactccagcctgggcaacagagcaagactccatctc

SEQ ID NO: 67920 - DNA, 218 bp, Homo sapiens
tgaggatgacttttgtccaacttcacaacagtatgatgcggatcttactgttacccaggatgaagtactgtggcatgatcacagctccctgaagcctcaacctctccaagctcaggtgatttcttccacctcagcctccaaagtagctgggactacaggcatgcgccactacacccagctaatttttttgtgtgttttggagagatagggtttcatca

SEQ ID NO: 67921 - DNA, 1991 bp, Homo sapiens
  misc_feature (1361)..(1361): n is a, c, g, or t
  misc_feature (1543)..(1543): n is a, c, g, or t
  misc_feature (1782)..(1782): n is a, c, g, or t
agcggatttcctctttcttactcttctatctccctactctccttcagcatcctcgcacaatgaactcttggggccgttttattctctgaggttagcaaggagtcatctactagccattcaggaggccagctgggaagacaaaataggcaccccaaactcagcaacttcataacaccttcctctccccgcctgaagccttaaactgcatcaagtcaaagaaacctggggcaaatccttaacatgtttttgactgcagtaaatccacagccactctctactccgagctggcagattgagaccaagtattcaacgaaagtgctcactggaaattggatggaagagaggagaaagttcaccagagacactgacaagacaccccaatccatttacagaaaagaatacatccccttcccagaccacagaccagaccagatctccaggtggtatgggaagaggaaagttgaggggctaccttacaaacacctgatcacccaccaccaggagcccccacatcgctacctgatcagcacctatgacgaccattacaaccggcatggttacaacccggggctgcctccactccgcacttggaatggacagaagttgctgtggctgccagagaagtctgactttccccttcttgctccccctacaaactatggactctatgagcagctcaagcagagacagctcacacccaaggctggcctgaagcagagcacttatacttcatcctaccccagaccaccgttgtgcgctatgtcctggagggagcatgcggtcccggtccctccccatcgcctgcatcctctcccacacttctgagagctgccaccccaggagcagctcagatagaatcagctggagaccacagcatcactggacttgccagacaacaagtggcgcagataaactcagagtacgagatctggcccgtcaaaggtgctctcagaatcatcatctgcatttggcggtacctgtcccccctcaaaacccacaggttcctttcttttccatccaacaattaaagatctttgacactattgcagggctatgtacgtgcacaagacagattcagactgtcagagaaaacaggaagggcccttaagttctaccctgttgtttcacaagaggggaaactgaggcccggagaggtaatgtgacttgctgaagagtctactcccatggaggaaatgaatctgatgatgaaacccatcatgaaaactccacagaatgactgaatgtggttcccaggagggcagtgctgcagagctggcaatggggaaggaccccagcttgtctgtcattgccaaggcagaggaaggcgtgctctggccccacggggctcagaagaagggganaacacatggcatttcctttgtctctgagctcgcaaatctttgtgtttttttttttgttttttttttttgagacggagtgtcgctctccagccttggtgacagagtgagactccatcccaaaaacaacaacaacaacaacaaacttacactaacggtagctgatgagctaaaaaaaaaatcgngtaaaaaaaccccataatgttttaagtaagtttacaaatttatgttgggccacattcagcctgcaggcggagggttggacaagcttgtgcgaaagtaaaggatgtcatgagagcaacgggcaggggttgacggatgatgaatgaagacctggcctgcctaggtagggccagggagaatcaggtaggtcaaggccagaaagctgagggagattacccagctgaagggacaggttgggagngaagagagggtggcttgggccatgggggcagcacgtttgaagtctctgacttgggaagaagctgagcaaattccttaaaagtccagaaagaccatgcattggtctcctattgctgctggaacaaaataccacaaactcagtgccctaaagcaacacatgtttatttgacagttcttattataaatgtgaataaatgcacatttattcag

SEQ ID NO: 67922 - DNA, 1963 bp, Homo sapiens
  misc_feature (30)..(30): n is a, c, g, or t
  misc_feature (1333)..(1333): n is a, c, g, or t
  misc_feature (1515)..(1515): n is a, c, g, or t
  misc_feature (1754)..(1754): n is a, c, g, or t
aagatagatcaactctccctaaaggctganagtgaactcttggggccgttttattctctgaggttagcaaggagtcatctactagccattcaggaggccagctgggaagacaaaataggcaccccaaactcagcaacttcataacaccttcctctccccgcctgaagccttaaactgcatcaagtcaaagaaacctggggcaaatccttaacatgtttttgactgcagtaaatccacagccactctctactccgagctggcagattgagaccaagtattcaacgaaagtgctcactggaaattggatggaagagaggagaaagttcaccagagacactgacaagacaccccaatccatttacagaaaagaatacatccccttcccagaccacagaccagaccagatctccaggtggtatgggaagaggaaagttgaggggctaccttacaaacacctgatcacccaccaccaggagcccccacatcgctacctgatcagcacctatgacgaccattacaaccggcatggttacaacccggggctgcctccactccgcacttggaatggacagaagttgctgtggctgccagagaagtctgactttccccttcttgctccccctacaaactatggactctatgagcagctcaagcagagacagctcacacccaaggctggcctgaagcagagcacttatacttcatcctaccccagaccaccgttgtgcgctatgtcctggagggagcatgcggtcccggtccctccccatcgcctgcatcctctcccacacttctgagagctgccaccccaggagcagctcagatagaatcagctggagaccacagcatcactggacttgccagacaacaagtggcgcagataaactcagagtacgagatctggcccgtcaaaggtgctctcagaatcatcatctgcatttggcggtacctgtcccccctcaaaacccacaggttcctttcttttccatccaacaattaaagatctttgacactattgcagggctatgtacgtgcacaagacagattcagactgtcagagaaaacaggaagggcccttaagttctaccctgttgtttcacaagaggggaaactgaggcccggagaggtaatgtgacttgctgaagagtctactcccatggaggaaatgaatctgatgatgaaacccatcatgaaaactccacagaatgactgaatgtggttcccaggagggcagtgctgcagagctggcaatggggaaggaccccagcttgtctgtcattgccaaggcagaggaaggcgtgctctggccccacggggctcagaagaagggganaacacatggcatttcctttgtctctgagctcgcaaatctttgtgtttttttttttgttttttttttttgagacggagtgtcgctctccagccttggtgacagagtgagactccatcccaaaaacaacaacaacaacaacaaacttacactaacggtagctgatgagctaaaaaaaaaatcgngtaaaaaaaccccataatgttttaagtaagtttacaaatttatgttgggccacattcagcctgcaggcggagggttggacaagcttgtgcgaaagtaaaggatgtcatgagagcaacgggcaggggttgacggatgatgaatgaagacctggcctgcctaggtagggccagggagaatcaggtaggtcaaggccagaaagctgagggagattacccagctgaagggacaggttgggagngaagagagggtggcttgggccatgggggcagcacgtttgaagtctctgacttgggaagaagctgagcaaattccttaaaagtccagaaagaccatgcattggtctcctattgctgctggaacaaaataccacaaactcagtgccctaaagcaacacatgtttatttgacagttcttattataaatgtgaataaatgcacatttattcag

SEQ ID NO: 67923 - DNA, 397 bp, Homo sapiens
  misc_feature (20)..(20): n is a, c, g, or t
gatctggccgtcagccgcgngccgctgggaactccactcggggaactcctttccaagctgacctcagttttctcacaagaacccagttagctgatgttttattgtaattgtcttaatttgctaagaacaagtaataagtaaatttttggaattccactcctgagctcaagcgatctgcccaactcagcctcctaaagtgctggaattacaggtgggagccaccactcccggctccactttgaattttgatttgaagagtaatatatagtatttgacactgagaaaaactgcattcaactgttcttcatccttgatgctcctatagaaatagttgtgaaaaaaagggaattccagcagcacaaggacgtcacccatacaggaaggaagggagggcagt

SEQ ID NO: 67924 - DNA, 574 bp, Homo sapiens
aaatcagctcggtccgtatccgtgtccggggttgggcctcctcttgggccaaccgctccagtccagcggtttctagctggacccctttctcctccagcatcagctctaccatgtccaaggggagtcccaggtctccacacagtgacaaggaccaagccttccacgtgcgccttatagcctctcaacttcttgcttgggatctccaacctcaccgcggctcgaaatggaccccaactgctcctgcgccactggtggctcctgcacctgcactggctcctgcaaatgcaaagagtgcaaatgcacctcctgcaagaagagctgctgctcctgctgccccatgagctgtgccaagtgtgcccagggctgcatctgcaaaggggcatcagagaagtgcagctgctgtgcctgatgtccggacagccctgctcgaagatatagaaagagtgacctgcacaaacttggaattttttttccatacaaccctgacccatttactgtattttttttaatgaaatatgtgaatgataataaaagttgctgacttaaaaagaaagataaggggggcccgggaccc

SEQ ID NO: 67925 - DNA, 3565 bp, Homo sapiens
  misc_feature (105)..(105): n is a, c, g, or t
  misc_feature (1189)..(1189): n is a, c, g, or t
  misc_feature (1363)..(1363): n is a, c, g, or t
  misc_feature (1680)..(1680): n is a, c, g, or t
catgccagttacttcctcaggaaaatattttcttgccttcttctttcagtatggttttaaatttgggaacagtggataacccaagtgtcccacaggccaaggtanattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatggcccaggtctcagcaccaccctctgtgacctaaaaagaaaagctcaatttccatctgtcttctttcccaggaccaaggggacacagtaatgtgaagtcaaatacttaaccgagcaaagggccagtattgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagccccagccagctcttcaaggccttcaaggggtctttccatgactgagtcacctccaggagctcacctgacccccagagaagacctaccccaggcagctccgtgccctggcttctccccatgccccaaatcccccccngccatccctcctggtcctcgtctacatcaagggcctcttcccctcttcctcccagctctcaggacaggtgactgggagaccttgaaccctcagcctcttcctttaaaaaaaacaaaacaaaacaaaactgtgggccatttatttgggattttggagttgtttggtttttgtttntatatcttaatagttcgaaagtaagaagggagccctgctatggatgttaagtccaaattactcggttagtgggagcaaaacctatgacttccaaggggatgaggagaggttcagaggacaggaggagcctcccccattgaaaaaaaaaaatgggtcaggacattccctggatgaggacaatgctaggggtggcatctcacatggctgctgctattcctggtgcttccccacacttttgacagatggagtccttctcctaccgcctcctgccacctcaccctacaggcattctctatgtaggaaacaagagccttatnttatagagtggggagctgagacacagcctcaggtaacactgacacagctcccgaatgaggctgggacactctgcaaacctctcctcatggtgctaagggtggcatgctcttgacaggaaacctaaatgaccactcctctcatttggaaagtaatccactgcagtaaaagtttcagacatgcaagagagagttttttttttttttactacaaatttttgctcccccataaaattatttttttattagagggagtatccaagttttaaaagtatatagaattttttggttgtaagagaaatacatactcattaggatcccgattaaattccttgagtagactggtgcctaccagaaagcaaagcaaagttaaacaaaacgaaacaaaatccttcatatacaaaaagaactttctgtttgtattggcagaggtagtgaggtgattcaggtaggctgaaaatcctgggttgcgggagcctcactttattccattcccacccgctttgatgtctatgcttggctctctgggctgcccctggtactgccgaatcctacacatctcttatcagctttcctcaaactttaaggaggctctgtgagggatgggtcatgggaagacccaagctttccctccgccaggattgcaaaagcaagtagacttggtctatgcagctcttcttccagcaatttctttatttggaattagaacttcctttgttagtatctttgatcttttgactcaagcacattttggaagggctcccttacaaaagtagaatttaaaacagaggatacagttaaagagcaacccaaaggacgcttaagaaaccgagaccacttcaccaaacaggactaaggaacactttcgtgcacagaagtcagccgcaatccaggcacaggacgaagatgggatacacgtgctcatctgtctgtcctcctttcctctccctccccgacgttctagttagcttgttgacttgttaaaccttctgttcttaaaatgaaaagctagcttacctcaaagaatcttgtttccattcggaaaccaacgattttgtgttttagaatggacagccctcccctcaccactccctaccttggcctggtgtccttgagacatacggtctttgcttagtcgtgtgttggctgctttgagcaggaacaaggcctccaggccctgaggtgggaaggaaggattggatgccactgccctcctccccactttagcatgtaggggccagcccatctcttccagcagggtcctgctgagttaccatagcaaccagcaactccagggtaccacaacagacaatggctcagcgagccgacgtgtggggatgatgcaggggttttggcccagccagaggacccagagttgagcttcaaatgctagagaaggggagaaacaggatggaagggtggtttaaggaactggcaggggtctttgagtcacatagagaagccgttgaaggaggtagggcaggttatctctgttccagtcacccccttccagccccatcccacttctgtttcaaactaaagctcccacctcgaacattgaccctttgttagaacaaagcaaagcatatctttagacaacagtgttaaaatgagcctcaaatgtatgtggatgagatctctaagaagagggtcttctggttttgatttttaaagaagagtatcctagtaaaatattaaaaaaaaattaaaaagtttttaaaaaggaaacctatgctatttaaattggagcccagttgtaacttggtaaaggcaagcttctgtacctttgttataattaattgtatacctgtgtatgtaaatataaggcattcctattttgcagttcagaacaaaaaaaacttatttgtaatatagaataaagtttatt

SEQ ID NO: 67926 - DNA, 1136 bp, Homo sapiens
  misc_feature (105)..(105): n is a, c, g, or t
  misc_feature (1113)..(1113): n is a, c, g, or t
catgccagttacttcctcaggaaaatattttcttgccttcttctttcagtatggttttaaatttgggaacagtggataacccaagtgtcccacaggccaaggtanattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatggcccaggtctcagcaccaccctctgtgacctaaaaagaaaagctcaatttccatctgtcttctttcccaggaccaaggggacacagtaatgtgaagtcaaatacttaaccgagcaaagggccagtattgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagccccagccagctcttcaagggtccttccatagtgacgccccccaaggacatctggaatgtnactggtgcccaggtgtacttgag

SEQ ID NO: 67927 - DNA, 3595 bp, Homo sapiens
  misc_feature (105)..(105): n is a, c, g, or t
  misc_feature (1189)..(1189): n is a, c, g, or t
  misc_feature (1363)..(1363): n is a, c, g, or t
  misc_feature (1680)..(1680): n is a, c, g, or t
catgccagttacttcctcaggaaaatattttcttgccttcttctttcagtatggttttaaatttgggaacagtggataacccaagtgtcccacaggccaaggtanattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatggcccaggtctcagcaccaccctctgtgacctaaaaagaaaagctcaatttccatctgtcttctttcccaggaccaaggggacacagtaatgtgaagtcaaatacttaaccgagcaaagggccagtattgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagccccagccagctcttcaaggccttcaaggggtctttccatgactgagtcacctccaggagctcacctgacccccagagaagacctaccccaggcagctccgtgccctggcttctccccatgccccaaatcccccccngccatccctcctggtcctcgtctacatcaagggcctcttcccctcttcctcccagctctcaggacaggtgactgggagaccttgaaccctcagcctcttcctttaaaaaaaacaaaacaaaacaaaactgtgggccatttatttgggattttggagttgtttggtttttgtttntatatcttaatagttcgaaagtaagaagggagccctgctatggatgttaagtccaaattactcggttagtgggagcaaaacctatgacttccaaggggatgaggagaggttcagaggacaggaggagcctcccccattgaaaaaaaaaaatgggtcaggacattccctggatgaggacaatgctaggggtggcatctcacatggctgctgctattcctggtgcttccccacacttttgacagatggagtccttctcctaccgcctcctgccacctcaccctacaggcattctctatgtaggaaacaagagccttatnttatagagtggggagctgagacacagcctcaggtaacactgacacagctcccgaatgaggctgggacactctgcaaacctctcctcatggtgctaagggtggcatgctcttgacaggaaacctaaatgaccactcctctcatttggaaagtaatccactgcagtaaaagtttcagacatgcaagagagagttttttttttttttactacaaatttttgctcccccataaaattatttttttattagagggagtatccaagttttaaaagtatatagaattttttggttgtaagagaaatacatactcattaggatcccgattaaattccttgagtagactggtgcctaccagaaagcaaagcaaagttaaacaaaacgaaacaaaatccttcatatacaaaaagaactttctgtttgtattggcagaggtagtgaggtgattcaggtaggctgaaaatcctgggttgcgggagcctcactttattccattcccacccgctttgatgtctatgcttggctctctgggctgcccctggtactgccgaatcctacacatctcttatcagctttcctcaaactttaaggaggctctgtgagggatgggtcatgggaagacccaagctttccctccgccaggattgcaaaagcaagtagacttggtctatgcagctcttcttccagcaatttctttatttggaattagaacttcctttgttagtatctttgatcttttgactcaagcacattttggaagggctcccttacaaaagtagaatttaaaacagaggatacagttaaagagcaacccaaaggacgcttaagaaaccgagaccacttcaccaaacaggactaaggaacactttcgtgcacagaagtcagccgcaatccaggcacaggacgaagatgggatacacgtgctcatctgtctgtcctcctttcctctccctccccgacgttctagttagcttgttgacttgttaaaccttctgttcttaaaatgaaaagctagcttacctcaaagaatcttgtttccattcggaaaccaacgattttgtgttttagaatggacagccctcccctcaccactccctaccttggcctggtgtccttgagacatacggtctttgcttagtcgtgtgttggctgctttgagcaggaacaaggcctccaggccctgaggtgggaaggaaggattggatgccactgccctcctccccactttagcatgtaggggccagcccatctcttccagcagggtcctgctgagttaccatagcaaccagcaactccagggtaccacaacagacaatggctcagcgagccgacgtgtggggatgatgcaggggttttggcccagccagaggacccagagttgagcttcaaatgctagagaaggggagaaacaggatggaagggtggtttaaggaactggcaggggtctttgagtcacatagagaagccgttgaaggaggtagggcaggttatctctgttccagtcacccccttccagccccatcccacttctgtttcaaactaaagctcccacctcgaacattgaccctttgttagaacaaagcaaagcatatctttagacaacagtgttaaaatgagcctcaaatgtatgtggatgagatctctaagaagagggtcttctggttttgatttttaaagaagagtatcctagtaaaatattaaaaaaaaattaaaaagtttttaaaaaggaaacctatgctatttaaattggagcccagttgtaacttggtaaaggcaagcttctgtacctttgttataattaattgtatacctgtgtatgtaaatataaggcattcctattttgcagttcagaacaaaaaaaacttatttgtaatatagaataaagtttattaaaaaataataaaaatgcagtttgggattt

SEQ ID NO: 67928 - DNA, 3541 bp, Homo sapiens
  misc_feature (105)..(105): n is a, c, g, or t
  misc_feature (1189)..(1189): n is a, c, g, or t
  misc_feature (1363)..(1363): n is a, c, g, or t
  misc_feature (1680)..(1680): n is a, c, g, or t
catgccagttacttcctcaggaaaatattttcttgccttcttctttcagtatggttttaaatttgggaacagtggataacccaagtgtcccacaggccaaggtanattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatggcccaggtctcagcaccaccctctgtgacctaaaaagaaaagctcaatttccatctgtcttctttcccaggaccaaggggacacagtaatgtgaagtcaaatacttaaccgagcaaagggccagtattgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagccccagccagctcttcaaggccttcaaggggtctttccatgactgagtcacctccaggagctcacctgacccccagagaagacctaccccaggcagctccgtgccctggcttctccccatgccccaaatcccccccngccatccctcctggtcctcgtctacatcaagggcctcttcccctcttcctcccagctctcaggacaggtgactgggagaccttgaaccctcagcctcttcctttaaaaaaaacaaaacaaaacaaaactgtgggccatttatttgggattttggagttgtttggtttttgtttntatatcttaatagttcgaaagtaagaagggagccctgctatggatgttaagtccaaattactcggttagtgggagcaaaacctatgacttccaaggggatgaggagaggttcagaggacaggaggagcctcccccattgaaaaaaaaaaatgggtcaggacattccctggatgaggacaatgctaggggtggcatctcacatggctgctgctattcctggtgcttccccacacttttgacagatggagtccttctcctaccgcctcctgccacctcaccctacaggcattctctatgtaggaaacaagagccttatnttatagagtggggagctgagacacagcctcaggtaacactgacacagctcccgaatgaggctgggacactctgcaaacctctcctcatggtgctaagggtggcatgctcttgacaggaaacctaaatgaccactcctctcatttggaaagtaatccactgcagtaaaagtttcagacatgcaagagagagttttttttttttttactacaaatttttgctcccccataaaattatttttttattagagggagtatccaagttttaaaagtatatagaattttttggttgtaagagaaatacatactcattaggatcccgattaaattccttgagtagactggtgcctaccagaaagcaaagcaaagttaaacaaaacgaaacaaaatccttcatatacaaaaagaactttctgtttgtattggcagaggtagtgaggtgattcaggtaggctgaaaatcctgggttgcgggagcctcactttattccattcccacccgctttgatgtctatgcttggctctctgggctgcccctggtactgccgaatcctacacatctcttatcagctttcctcaaactttaaggaggctctgtgagggatgggtcatgggaagacccaagctttccctccgccaggattgcaaaagcaagtagacttggtctatgcagctcttcttccagcaatttctttatttggaattagaacttcctttgttagtatctttgatcttttgactcaagcacattttggaagggctcccttacaaaagtagaatttaaaacagaggatacagttaaagagcaacccaaaggacgcttaagaaaccgagaccacttcaccaaacaggactaaggaacactttcgtgcacagaagtcagccgcaatccaggcacaggacgaagatgggatacacgtgctcatctgtctgtcctcctttcctctccctccccgacgttctagttagcttgttgacttgttaaaccttctgttcttaaaatgtgttttagaatggacagccctcccctcaccactccctaccttggcctggtgtccttgagacatacggtctttgcttagtcgtgtgttggctgctttgagcaggaacaaggcctccaggccctgaggtgggaaggaaggattggatgccactgccctcctccccactttagcatgtaggggccagcccatctcttccagcagggtcctgctgagttaccatagcaaccagcaactccagggtaccacaacagacaatggctcagcgagccgacgtgtggggatgatgcaggggttttggcccagccagaggacccagagttgagcttcaaatgctagagaaggggagaaacaggatggaagggtggtttaaggaactggcaggggtctttgagtcacatagagaagccgttgaaggaggtagggcaggttatctctgttccagtcacccccttccagccccatcccacttctgtttcaaactaaagctcccacctcgaacattgaccctttgttagaacaaagcaaagcatatctttagacaacagtgttaaaatgagcctcaaatgtatgtggatgagatctctaagaagagggtcttctggttttgatttttaaagaagagtatcctagtaaaatattaaaaaaaaattaaaaagtttttaaaaaggaaacctatgctatttaaattggagcccagttgtaacttggtaaaggcaagcttctgtacctttgttataattaattgtatacctgtgtatgtaaatataaggcattcctattttgcagttcagaacaaaaaaaacttatttgtaatatagaataaagtttattaaaaaataataaaaatgcagtttgggattt

SEQ ID NO: 67929 - DNA, 1116 bp, Homo sapiens
ttcctcaagaggacataacagtcccaaacattcgtgatctaatagcttcaaaaatcttgaagcaagatgttaagaactacaaggaaaaatagacaaattcacacttaaaatcagagacttcaatacccctctcgataactgataggaaggtagaaagaaaatcagtaaggatacagatgacttgaacaacaatactgaacacaacatatcctaattgacattaagtgtaccctttacccaacaacagtagaatgcaccttcttttgaaagaagaatggatcataaagtaagcctcaataaatttaaaaggattttagtcagatagtgtgtaatttcctgaccacagtagaattaacttggaaattaataacagagaggtatctaggatatcttcaaatattgggaaattaacatattccaactaacccttgggtcaagaaaatgaaaagggaaattacaaagtatcatgaactgaatgaaaattagaacacaacatcaaaatttatagcatgctactaaagaagtatatatagagacatttgtagcactaaatatttgtattagaacaaaggtctcaattcaatgacctttagtttcttccttaagaaataagaagaaaaagagaaaattaaaacccatagtaagtagaagggaaataataagagaatgaagaccaatgaaatggaaaatagtaaaaccataaaggaaagaaaaactggcagagtgtagtggcttatgcctgtaatgccagcactttgggaggctgaggcaggaggattgcttgagcccagcagagcagttcaagaccatcctgggtaacatagtgagaccccacctctaccaaaaaaaataaaaaataaaaaccctaaactggctttttggaagatcagtcaaattgacaagactcttgccggaatgatcagataaaaaagagaaaagacacaatatcaggattgagagcggtatcttcactttagatccttcagatgtttgaaagataataaatactataaacaactttatgccaataaattcagcaagttaaatgaaatggacatattacttgaaaggcacaaactaccaaaattcactcaagggaaaaaaaaagataatatc

SEQ ID NO: 67930 - DNA, 458 bp, Homo sapiens
actgcaggctctttgaatctcttttaaataggaatgattcagagattaagaagccatttataataaagcaaacaattcaatgccatttctcaatggcccaaacaagagagtttgttttgggaagttggttccagaatacacagatcatataattgcacagtgtcagagctggaaatgctgttagggagtaaccagtctattttacatatgacaaatgtgaagttcagaacgactgtgagtgagctgtccaagattagggatgcattcaagcttcattaaataagtattaactgagtgctatgtgccaggtgatagggataggaaggcaaataaaacacgatctttgtccatgtagtggaagaagacaaataagtgaataattgcagttaaattgttgcataagtgggactccaactctgtgtccaatttcataatcaaaggtctatcccactacctta

SEQ ID NO: 67931 - DNA, 382 bp, Homo sapiens
ttctgtaagccccgcccccactgcgtgcgggcggcttttgtctccacggcaaccgtcaactctggaaacgcctgtctttctccatggcaactgtctacgccgcaggctggagctgcccattaccggagcccgtaagcagtatgggtgctggacaaacagcgtgatcgggtcgtaaaacttggtggaaaacgaatattagagcacaaggaaggaaaaaccgggctgggtgggactgaaatagttgatgtgagggaagatttctcaaagggagactatttttttattgtttgtttgttttttacttttattttttcaagacggggtctcgctctgttgcccaggctggagcacagtggcacgatctcggctcactgcaacctcc

SEQ ID NO: 67932 - DNA, 4697 bp, Homo sapiens
ctattagagatgctgcaaggagaatgagagagatgcctggttagctagcagttcttccacctagctcagctgaatcaccaggtgtgtgagtggggtaattttggatttcagccccaaatgagtgtgcagaaaactgcttctgcatgaatggcctatgtgagatcagcagaaaagccagccagctgagccttgctcagattgtaaaatcataagcagatacacagtcatgttaagccattaaatttgggagtgttttgttttgtagaaatagatatctgaaatacccagtgacttacacatttacttcatctccatatactgaagaccgagtgttagtttctatcatacctatgcccgtcccaagatactgggccctcaggcaaggtgaggttctagttcctctaggaaaggcaaagaaatttaagggatatggggtgttaaaattagacaagtgaagatgcagttggtataagaaaattcatatcaactatcagaaggctgcttttgcaagaggaatatagttggttttgagaattcaaggaatgggaagataaaacatgttgagaatccacatatgaataaatatatttaacttcagtgtgatgaagctttctttacaggtgcttcacaaaggggctttggctttccaccttgttgagatacgtgactgttgtggaggtgtgcttcttggtcttccttcaagaaagagcttgttcttcagctatgaggaatacagatagatgacaggtcttggctcccaaacctttagaatcctctgcaggattcaagctaaggtcatacttttccagatcatctcccagccaatgactgagcatgatggggtactagggacctgaccatttcttccaatgtaggattcacttgaccagttgtctttttggcagagtgccacatgggttagtcaagacagtgtggaatttttattgcattccctgcattgttctccatgtccaattcttcttaccctcttttttccccccacaaatgtcagatctgccttgtggtctgaaggctttctctgcataaccctttttcattcccctttacctttcctggtgttactcccagcaatctcgtacttctaactctggctcagcatctgcttctgagcaaggtacagttgagagaactaaaatggcaaatctatcagattaatatgatctgtagtttgtttgcttttaggtagagttggataatcattttacaacaattctaagaaaacttagtgtgttttactgcatgagatgccttttgaagtagagaagacatctgtctaaatcaccaactttatactttgggaaatctgtgttttttgccgaattgcaaaattgcattcgtcttatagtccttaaaatttattttacttcctaatatttgtaactacacagagtcatttgaatctgctaaacatagcacaaaaggtggatatacatcagtatttagtaaaagacatctatttaaattaagcaccttgcaacatgtattcagctatgaggaattttccgagcaagtagcattaacattgaaaattattatagagcttatggggggaggagccaagatggccgaataggaacagctctggtctacagctcccagcgtgagcgacgcagaagatgggtgatttctgcattttcgtctgaggtactgggttcatctcactagggagtgccagacagtgggcgcaagtcaatgggtgcgcgcaccatgcacgagccgaagcagggcgaggcattgcctcactcgggaagcgcaaagagtcagggagttccctttcctagtcaaagaaaggggtgacagatggcacctggaaaatcgggtcacttccacccgaatacagcgcttttccgacgggcttaaaaaacgccgcaccaggagattatatcccgcacctggctcggagggtcctacgcccatggagtctcactgattgctagcacagcagtctgagatcaaactgcaaggtggcagcgaggcttggggaggggcgcccgccattgcccaggcttgcttaggtaaacagagcagccgggaagctccaactgggtggagcccaccacagctcaaggaggcctgcctgcctctggaggctccacctctgggggcagggcacacacaaacaaaaagaccgcagtaacctctgcagacttaaatgtccctgtctgacagctttgaagagagcagtgtttctcccagcacgcagctggagatctgagaacgggcagactgcctcctcaagtgggtccctgacccctgacccccgagcagcctaactgggaggcaccccccagcaggggcagactgacacctcacagggctgggtactccaacagacctgcagctgagggtcctgtcagatagaaggaaaactaaaacagaaaggacatccacaccaaaaacccatctgtatatcaccatcatcaaagaccaaaagtagataaaaccaccaagatggggaaaaaacagagcagaaaaactggaaactctaaaacgcagagcgcctctcctcctccaaaggaacataattcatcaccagcaacggaacaaagctggacggagaatgactttgacgagctgagagaagaaggcttcagatgatcaaattactccgagctacaggaggaaattcaaaccaaaggcaaagaagttgaaaactttgagaaaagtttagaagaatgtataactagaataaccaatacagagaagtgcttaaaggagctgatggagctgaagaccaaggctcgagaactacgtgaagaatgcagaagcctcaggagccgatgcgatcaactggaagaaagggtatcagcgatggaagatgaagtgaatgaaatgaagcaagaagggaactttagagaaaaaagaataaaaagaaacgagcaaagcctccaagaaatatgggactacgtgtaaagacgaaatctacgtctgattggtgtaactgaaagtgatggggagaatggaaccaagttggaaaacactctgcaggatgtcatccaggagaacttccccaatctagcaaggcaggccaacattcagattcagaaatacagagaacgccacaaagctactcctcgagaagagcaactccaagacacataattgtcagattcattgaagttgaaatgaaggaaaatatgttaagggcagccagagagaaaggtcgggttacccacaaagggaagcccatcagactgacagcagatctctcagcagaaattctacaagccagaagagagtgggggccaatattcaacattcttaaagaaaagaattttcaacccagaatttcatatccagccaaactaagctttataagtgagggagaaataaaatactttacagacaagcaaatgctgagagattttgtcaccacgaggcctgccctaaaagtgctcctgaaggaagtgccaaacatggaaaggaacaactgataccagccgctgcaaaatcatgccaaaatgtaaagaccatcgagactaggaagaaactgcatgaactaatgagcaaaataaccagctaacatcataatgacaggatcaaattcacacataacaatattacctttaaatgtaactggactaaatgctccaattaaaagacacagactggcaaattggataaagagtcatgacccatcagtgtgctgtattcaggaaacccatctcacatgcagagacacacgtaggctcaaaataaaaggatagaggaagatctacgaagcaaatggaaaacaaaaaaaggcaggggttgcaatcctagtctctgataaaacagactttaaaccaacaaagatcaaaagagacaaagaaggccattacataatgggaaagggatcaattcaacaagaagagctaactatcctaaatatatatgcacccaaaataggagcacccagattcataaggcaagtcctgagcgacctacaaagagacttagactcccacacaataataatgggagactttaacaccccactgtcaacattagacagatcaacgagacagaaagttagcaaggatatccaggagttggactcagctctgcaccaagcggacctaatagacatctacagaactctccaccccatatcaacagaatatacatttttttcagcaccacaccacacctattccaaaattgaccacatacttggaagtaaagctctcctcagcaaatgtaaaagaacagaaattataacaaactgtctctcagaccacagtgcaatcaaactagaactcaggatgaagaaactcactcaaaaccgctcaactacatggaaactgaacaacctgctcctgaatgactactgggtatataacgaaatgaaggcagaaataaagatgttctttgaaaccaacgagaacaaagacacaacataccagaatctctgggatgcattcaaagcagtgtgtagagggaaatttatagcactaaatgcccacaagaggaagcaggaaagatccaaaattgacaccctaacatcacaattaaaagaaccagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccgctagcaagactaataaag

SEQ ID NO: 67933 - DNA, 459 bp, Homo sapiens
ttatattacaaaatgtgttgagctatgggagaaaaaaatgaaataaattctgagcagataactaacatgttataatgccatagcctttccatcttccttgtgttttttatcttgttttcacgtcatttgctgtaaatatttttagagttcactatgtgtcagttactattgtatgacttgtgtaactaaatgaacaaacatataaacaatgtaatttcaagcacaataaataacagaaggaccgatggtgtatgacgaaggtaaatgatatttcttattttgaataggtgatcagggaaagtctatttaaagaagggataaattgttgtcctggagagcaacagggtctagaaacattccttcgtcagtctgatctggacttttggttcctggttctagatccgctcctaccttgatgatctccaaaaccagcgttcatggttgatttttaaagaattc

SEQ ID NO: 67934 - DNA, 1452 bp, Homo sapiens
tctgaaaaataaataaaagcaggcagtttctggggagagaccaacacagaaatgagtttatcatttcctttcctcatgcatctttgccccaagggcagtcacatcatggcatggcacctctggcagataaacttcaagagaaaccccatatttcctgaacagagaagcctgagaaagaggcctctttgtgcagaaagtttgaggggaatcccatacaagtttcaccctaccccttgacctgcacagttatgggacagatgcaaactggaatagaaaaggcttaagtaactgaactgcaagttcactgcctacaaaaagtaaaacacaaattacagtctgaatataactcaagtgtttgcctgctgaaacaagagcatcaacaatctcggaagtattataacagtacccaggctacataacataatattcagtgtccaagataaaatccaaaattacttggtataaaggaccaggaaaatgtgaccagttctcaaggaaaagacaactccagaatgactcagatgttggaagtatcagggaaaaactttaaagcagcttccataactggttcctttaggtaaaggaaaacacatttgaaataaattaaaataaattctagcaagaaatagaatgtattaaaacaaattttataactgaaatataatccaatgtaaactgatcaaatgggttaaataacagaatggagatgacaatgaaaagtaaacttaaagatacagtaatagaaattagaagaagagagaaaagatttttataaaaataaacagcctcagggacttgtgtgacaatatcaaaaggaacaaatgaaatatggataactggagttccagaagaactgaagagagattctgttagaaaagatatttgaagatttgaaaaaataatggctgaaacctccaaaattggtaaaagatacagatttatagatacaagagactcagcaaattacagacagaattaaactcaaaaccacacttgcacacatcaaaagtaaactaaaaatcagagatattcacctgctaacaagaaaacggctgctaaaaaaaaattaaaatacactgaaagctgttaaaaaattattcattacctacggagccataaagatttgaatgtacccatgcacttttcatcacaatccttggaagaatttagtggaatggtgcctttaacgcattggaagaaaagacctgtcaactcagaattttatatccagtgaaaatattcttcatgggtgaaggtgaaataaagacattttcagataaaataattcatgagcaatgggattgctctatgagatatgctgaaggaagttatttaaactgaagaaaaatgataccaaagagaaacctgcatcttcaggaataaaataaatgcaaaataaatggtaaatagctggttattagaaaagattacttttttgcctcctaaactgaa

SEQ ID NO: 67935 - DNA, 421 bp, Homo sapiens
gacaccaggagtccaggccccaagtcctttgtgtctcagcttgaccccttgagaccacccccttgcttggaggtttatgccagcggtgacctggaatcctacctcctatatcctggtgggtcacaaatactaactttaaaagaagcaacgacacccccatcagacacccactcctgtgaatatggaaatacggcccaggaacctcactgccgggaatactcaccgggttatactctgaatatgccacaaggatgtagaatagttcccgctgcctgggaaacagagaaagggggctagggtttggtttgtgcagatgctgttagtttcactttgtctacaaatcctaacaacaaatcccatttcaggttcagatgattcgacagataagcagtgaactttcagggcctgagattgttgaaga

SEQ ID NO: 67936 - DNA, 430 bp, Homo sapiens
gtcctgtccagacctccatggtttcccccacttctagctctaagccactagcgccgggtattgttacagttctttccccagcaatcgtttttcccataccaggtccgtacctgttttaattgcctcctgttcactctgtcgttgaggaagtgattcttgacctaggtttatggaaacggccaaacacctgacacccaacactggacagatcgtgtttttggtgtcatatctaagaaattgaggaaccatcagaggggatcattaaaagccaaagaaaaggctttcagttctggaaggatgggcaaactcctactggaaacattattacttatcaaggttttcttagtcgtccatgaaaacaccttatcttggtatagctggatggctttggtttcggctggttcaggtgagtaagtggttttctttctct

SEQ ID NO: 67937 - DNA, 460 bp, Homo sapiens
gaaatatttactacttccagcctcataatcctgcagtcatttggcacctctgaagccttggggagcactgaagccaaggctgcaccgtaccaaaaatttgaaacatgtgaatgagctgaatgtggaaggactaccggaaaacactcctttcagaatcccctcattgcatgaaatcccaaggctcgaaaacatctttcaagtgagcaattgaattaagtttgttattaagagcttggtgaaaggtagaagttacacgtgagaaggcggtggagccaggcacatgatggagcctcgaagagtggaaggtggcacctggctctgtgaggagggtgtgaagtcctccatgggaggaagagatgccagcaaaggagtaactccagttagcctccattgtctccaagccggcttttgtcctcatccacaacgcctccacacaagctctgaacacctgtccatgtaa

SEQ ID NO: 67938 - DNA, 295 bp, Homo sapiens
ccatagcacttttgaaatgtttctatttatagcacctgttatatcactgtaactgtatgttggcatgagtttcttctactaaatcagggggtcttaatctgttttttgttgatgtctttgggggtgtgtgaactgctggaaaactgtactaaaaggttatattagactagtggttggcaagctacagcctgtgaaccaaatctagcctgctgcctgtttttgtaaataaagttttgttgaaacacagtcactcccatttctttatgtattgtctatggctccttttgtgctacca

SEQ ID NO: 67939 - DNA, 2470 bp, Homo sapiens
tgtggacctgggcgagtgactcgttgtgtgctgtgcccgcaggagatgctgcaggataagggcctgtccgagagcgaggaggccttccgggccccgggcccagcgctcggagaggccagcgcagccaacgcccccgagcccgcgctggcagcgccgggcctcagcggagccgcgctaggcagccccccgggacccggggccgacgtcgtcgccgccgccgccgcggagcagaccatcgagaacatcaaggtggggctgcatgagaaggagctctggaagaagttccacgaggcgggcaccgagatgatcatcactaaggctggcaggaggatgttccccagctacaaggtaaaagtcacaggcatgaaccccaagaccaagtatatcctgctgattgacattgtccctgccgatgaccatcgctacaagttctgtgacaacaaatggatggtggcagggaaggctgagccagccatgccaggaaggctgtatgtccacccggattctcctgccacaggagcccactggatgcggcagctggtctccttccagaagctgaagctgacaaacaaccacctggacccctttggccatatcatcctcaactctatgcacaagtaccagccgcggctccacatcgttaaggctgatgagaacaatgctttcggctccaaaaacactgctttctgcacccacgtgttcccagagacctccttcatctctgtgacctcctaccagaatcacaagatcacccagctgaaaattgagaacaacccttttgccaagggattccggggcagtgatgacagtgacctgcgtgtggcccgactgcagagcaaagaataccccgtgatttccaaaagcatcatgaggcagaggctcatctccccccagctctcagccacaccggacgtgggccccctgctcggcacccaccaggcactccagcactaccagcacgagaacggggcacactcacagctcgcggagccgcaggacctgcccctcagcacctttcccacccagagggactcaagcctcttctatcactgcctgaaaagacgagacggtacccgccacctggacttaccttgcaagcgatcctatctggaagccccctcttcggtgggggaggatcactatttccgttccccccctccctacgaccagcaaatgctgagcccctcctactgcagtgaggtgacccccagagaagcatgtatgtactcaggttcagggcccgagattgccggggtgtctggggtggacgacctgcccccacctccgctgagctgtaacatgtggacttcagtgtcgccgtacaccagctatagcgtgcagacgatggagactgtgccgtaccagcccttccccacgcacttcaccgccaccaccatgatgccgcggctgcccaccctctccgctcagagctcccagccaccaggaaatgcccactttagtgtctacaatcagctctcccagtctcaggtccgagagcgggggcccagcgcctcattcccaagagagcgcggcctcccccaagggtgtgagaggaagccaccctcgccacatctaaatgctgccaatgagtttctctactctcaaaccttctccttgtcccgagaatcttccttacagtaccattcaggaatggggactgtggagaactggactgacggatgactctcacgtctcctccatagccccgggaccgtgttgctccagtattaacctctgtgggtggcctgcactctaccaagaaacacaggaaggtattccagtgtgtgtgtgtgtgtgtgtgtgtgtgtgtgtgtgtgtgtatacacgagcatgtatgtatttggagagcatccatcttctgacatacaactgaggtcatgacaaggaaaaaaaacaccacatttatctaagaagtgattttggctgcaggacctgggtctattgttatctgacatctcttgacatgcccgtgggtgggatgggagtggagggttcatatgagttattgagagggttttataatggttgatttactcaggggccaggtggggagttctctcccatggggaaagattctcactgctggggtgggaagattctcgctgctggggtgtgaggactctgtgcacaccttagagttcctggccttctctttgcaaggggagctgagaatctggttttggtagcaggaggcccactcctttgacttctggagagtctgtgagactgcctgagaggtgggctcagctaagccacaatgtgtactttgatagtacagctggctgctcagtgagtggcctagacattgatgactggagctctgaggtctgagggatgacgttcggaaagggtcatgggctaaatgtcacctgaggggtatttttaaagggtttttttttcccttcaagaggagggaaaatgcaaccagtagcatctctgtcatcattcagattttgtaataaagtacaga

SEQ ID NO: 67940 - DNA, 1087 bp, Homo sapiens
tattaatgggagaatctgtaagttatgtctgaactttcaggttgtcttataattgtctttttccttatgtcagatgttctatgtcataagaataaaatggttcacaccaatacaagtacttagttgtggaaagggagagtagaagataaaaatggagattttcctgtgctacaggcttagtcaagcttatggtctatttaatggttatcaaaggcaattaaatagtgttgagtgttctgcttttacctacatttcatttttcatgtacttagttacaaattgaaccctcttctatttttttcctgctcctgtttctgtttcattttagttttccttttccctgattatcatttaggcatgtaagtgacacccagtagcattgctttaattctgctggtgacagtgccaaagctttactatactctttttgttgtctgttgcttttctcttgctaatttgcttgactagataactaagaattcaggtaagcattagctctttgttcactgagaataatacaacttgcaagataattaatttggattgttctacatgtatttcgtttatttctctttaccttgttcatttattacgacattttgaattatttacatacccatatttcttctttcttttatggctcagctcactatgcttttttttaatactggtagcttcctcaaggttggaaaacaagatctgaatactatagaaaataataactatttttctgtggtcatattaaagatataatggctttggattttggggtgatttttctactgtcagtttaaaaaaaacttgtctatttgcatttgtgtgttattacttctagttaagagtatttccaaggaaagtttcatgttacttattttgtttccatgtctttttccaaaagaacttattttttatattataataaatatcagtggaaaagtaggtttcgttatatagaaattaactttaggctgggtgcagtggctcaagcctatatttgggaggccgaggcaggaggattgcttgaactcaggagttcgaaactagcgtgggcaatgtagcgagacctggtctctacaaaaaaaaaaaa

SEQ ID NO: 67941 - DNA, 349 bp, Homo sapiens
cattcaggccaggcacagtgactcatgcttgtaatcccagcatgcttgaagacatagcagtagggactatcgacaaagaaacacacagagggaaaaagaattccacatttgggaggctgacgcatgaggatcacctgaggtcagaagttcaagacaagcctgggtaacatggtaaaaccccgtctccactaaaaatacaaaaattagctgggcatggtggcctggggctgcaatctcaactacttgggaggctgaggcatgagaacctcttgaacccaggaggtggaggttgcagtgagcagaggtcatgctactctcaagcctgggcaacagagcaagaccctgtctc

SEQ ID NO: 67942 - DNA, 1625 bp, Homo sapiens
  misc_feature (415)..(415): n is a, c, g, or t
cttggctgttgggaatgtcccagtcacaggacactgtaaagagccaccagggccatgggatcgatgggagttcaccttgcccacagcagtctgcagagctaatgggggtgctgaatgtgtagggggcatctcatcactttcttccagaagttgagtaccaggttggtaccttctgcccatcctgcaggtgtctgagctgcctgaaatggttggtactctcagggagaccttggcaaggcaaggtccctctctgggctggtttttctacctgtaaaattgggagagagtgtcggacacagtggctcacacctataatcccaagcaccttgggaggcagaggcaggaggatcacttgaactcctgacctcaggtgatccgcccgccttggcctcccaaagtgctgggattacaggcntgagccactgtgcccagtgagtagtgtagtttttaaaaggagagccaggagggagccgctgttccgagtttcttgtctcatagaccttcacaggaaagagggcacctcaggtagggtttgagtgggatctcagaaggaagaggctgcactaaagaaaagggacagaaacgccggagtagggacttgcattttggctggagcatgcggaaccccctgagcagtctgagaaggtggctgggggaccacgtggggccccaaacaccaggctgaggtttagactccatcaagggcggtgcaaggggagcctcacacactcatgcctctctgttctctgtctttcccactctttccaaagcaagctaaagtatcccattaatcttccccagtgcagaggattaagctggtggctctcaggtttgaacacgcatcaggaggccctgtatcaatgcagagtgtggacccacctccagagcttccaggccctagaatctgcatttctaacaagtccccagatgtggcagatgctgctggtcctggggttacattttgaaaaccactgctttagagtaatggcaaatcctacatgctgaagccaggcactgctccactgtaaccaccaactacccctgcctggacttcggaattccctctgcacgatggggctggaccgggcattccaggagggctgccctaatcctgtctgacctcccgggaggtgctggagagagcaccaccttctacgcccagggtgaagttctgtggcttgttgactgtgccttcgagggctctatgtcattctgtcccctatcacctgcctgctgtgcacctgtcgtgcttgatctagctcagacattttgtcacactccttggggaggagcgggattggaacagttgcttggcgtggcaatggcctggccaccagtcgacatttgcagccagcatctgggtaccttgggagctcccagcctcccctgggcagggctggggccgtgaattggacacggcattgcgcttaacagcgcggctacctcaggctgctggtaagtaccagaatgctgtttctcctttcttggctttttgtcttacagaaagctcgctcccccatgaccctgcaccttcaaagcacttttctcataggttctatattagctggagaaaaaccttcaagggcatttggagaaaaaataaaaagcactagttcaggtacctt

SEQ ID NO: 67943 - DNA, 636 bp, Homo sapiens
ctttttgtctctgatgatgtgagtccattgctcacatatctggctgtttcatccaaaaaaaaatattttacttttggcttaaaagcccatctcaacataaacatcggagctcccgaatgttgctctaacagcttgacaactctgtaggtgtagagctggctgcccgccaatccaaatttttctgcttctttcttttaatataaacagagcctttgaagaactgtggattcattgaatgaacaaatgaacttgtttacataaaacatgcaggaggaaatttccactgtgcttcaacatataatttcagtctgtttttggatgggctggtgcattatggagattgtttttctagaccaggatgctgtcctccatatggtggcctcattgttcactccagtcggtaagttcaaggtttagctatgaggggagaaggggtacaaaattaaattctgctatgttggttcacaaagaacagactcgagtttggaagacccctgaccaattataggaaagaaagaaatggaaatgtgtttttttcttagtgtatgatgttttatagaaacagaagcaaaggtcttctggccggctcttctgaccctccactccaaatatgcaccctgaatctagtgatttaca

SEQ ID NO: 67944 - DNA, 407 bp, Homo sapiens
tgttgaattaaagatgaaagctgtagtatccatgaaaacaaaaatttgtaaaagacatgaaagaacataacaactttatatgtataatgtttttgtctgttgaagagctgcagaaaattacttgatgtttagtgccagctgcagtagcatgctaaactgcacatgttccaccaaggaaaaaacaagtcctcattcctcgtggataggcacacaaatttgacttttcactatcacctatctaagcaggcacctgttattactcatgtggtataatactccatttccattggagatttttgtgagaagtaactcataattgttaatgcaacaaaatgtgtgtccatacaattagcatgaatgtaaatatgtccatctacattttatttccttctggatgttagcgaaat

SEQ ID NO: 67945 - DNA, 628 bp, Homo sapiens
gacgtgcttggctgctgcggagttctgaagagcatcaggaatgtggctgctcctggagcctttcctgggcttcttggacatgtgtctggagccctccctccctcttagcgggtgatgggaatcagcagaagcatgcatcacggggaaagctggccttcaggtgtacaaggatggataaaaaggcagacttgcagggaaaggctaaggaggaaggagactgtttacagagtagctggagggctggcgggcttgggtggaggagctgaaacagtaatggggatacaggaaggagactgccccgagagaccgtttccactaatagaaggcattggagggcagggacgggaaaagggcaagtacccaagttctaggccaaagctctaagtgtttgtgaaactggaacagcaaaagctacttcttaaaaaccttaagattttgtgggtatctagtgagcgtatatatttacggggtatatgaactgttgtgaaacaggcatgcaatgtgaaataagctcatcatggggaatgggtgcccatcccctctagcatttatcctttgagttaccaatgccacttttttttggaggggttggcagggagtactaaataaaaagttcacatctcttgtt

SEQ ID NO: 67946 - DNA, 620 bp, Homo sapiens
caccatctccggacgcaaagctttcgcattcagcttgaggagctaaaccatttcaagccaaggtttcttcacagattaggataaaggatgaagagaagtaaactgaattactaaggatgcaacattaatggagagagccaagtgatgtaaatcgtggctggccatgagtggatcttgagtgccagttatctagagaaattccacgtggctgttccaggatggattaggcaccaatgactctctttcaccctcgagctggaatcctgcccctttaacacctttccagagagaggcaacccatggagggtcacagcaagatgggatggttgtgcctggtagtaaaaatatgtatcactcttcatttcatccagctttgaagcttctgctagcagctcacacatgaccccaagggcagctcctcaagtctgctaaagaaaagttaagtagaattaattttgttcaatatctcccattttgttagattcatcattttcagtcaagaatgacaatattaatggaaccaaaagaatatatactattaacatttcgtcttaattctacaaatgtctaaaagtctctgtaattcccttaaaaataaaaaaaatgcaatattaatttag

SEQ ID NO: 67947 - DNA, 2176 bp, Homo sapiens
  misc_feature (2)..(3): n is a, c, g, or t
cnngcgttcgcctctacgttccgcgcgggagcccacgcgcggttcgtccggaacccacagaccagagacgcaggtcccagccttttcggtgtcggcgccagttcccggaggagcggacatgagtgaaagccaggatgaagttcctgatgaagttgagaaccagtttatattgcgtctgcctctggaacatgcttgtactgtcaggaacctagcacgttctcaaagtgtcaagatgaaggataaactaaaaattgacttattgcctgatgggcgccatgcagttgttgaagtagaagatgtcccactagctgctaagctggttgacttgccttgtgttattgaaagcctgagaacgcttgataaaaaaaccttttataaaacagcagacatttctcagatgcttgtgtgcactgctgatggtgatatccacctttctccagaagaaccagctgcctctactgatcctaatatagtcaggaaaaaagaaagggggagagaagaaaaatgtgtctggaagcatggcattacgccaccacttaagaatgtcagaaagaaaaggttccggaaaacacaaaaaaaggtccctgatgtcaaagaaatggaaaaaagcagctttactgagtacattgaatctccagacgtggaaaatgaagtaaagagactgctgcgttcggatgctgaagccgtaagtacccgttgggaagtcattgctgaagatggaaccaaggaaatagaaagtcaaggctccatcccaggatttttgatatcctcgggaatgagcagccacaagcagggtcatacctcgtcagaatatgatatgcttcgggagatgttcagtgattctagaagtaacaatgatgatgatgaggatgaggatgatgaagatgaggatgaggatgaggatgaagatgaagacaaagaagaggaggaggaagattgttctgaagagtatctggaaaggcagctgcaggccgagtttattgaatctggccagtatagggcaaatgaaggtaccagttcaatagtcatggaaattcagaagcagattgagaaaaaggagaaaaagctccataagattcagaataaagcacaaagacagaaggatctcatcatgaaagtggaaaacctgacactcaagaatcattttcagtctgtgctggagcagcttgagttacaggaaaaacaaaaaaatgagaagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctcctgagtagctgggactacagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattttgagccttttcctcctaaccctcatcagttaaggttaggaagaacaagatgccataatgcctatgaagacttctttaacaatcttgtttgggtttttttctaggtatattattagtgttttatggtctatgttctttaagcaataaataaattgttcctttt

SEQ ID NO: 67948 - DNA, 2104 bp, Homo sapiens
atttgttcatcaaattacatcatgtaatttggattgactttggaaaatctacacatattggagaggagctaaggtaacgtctagaaataattaagttatgtcaaataaggtattgtctaactgtacacacatcattctagtgaggattatgggcaagatcttgtataatttagccagtactaccagaagtggtcaggagagggagcaagaggagtttttagtgatggttttctttttgctttcatgaactcaaaatcaagacatgagtgaaagccaggatgaagttcctgatgaagttgagaaccagtttatattgcgtctgcctctggaacatgcttgtactgtcaggaacctagcacgttctcaaagtgtcaagatgaaggataaactaaaaattgacttattgcctgatgggcgccatgcagttgttgaagtagaagatgtcccactagctgctaagctggttgacttgccttgtgttattgaaagcctgagaacgcttgataaaaaaaccttttataaaacagcagacatttctcagatgcttgtgtgcactgctgatggtgatatccacctttctccagaagaaccagctgcctctactgatcctaatatagtcaggaaaaaagaaagggggagagaagaaaaatgtgtctggaagcatggcattacgccaccacttaagaatgtcagaaagaaaaggttccggaaaacacaaaaaaaggtccctgatgtcaaagaaatggaaaaaagcagctttactgagtacattgaatctccagacgtggaaaatgaagtaaagagactgctgcgttcggatgctgaagccgtaagtacccgttgggaagtcattgctgaagatggaaccaaggaaatagaaagtcaaggctccatcccaggatttttgatatcctcgggaatgagcagccacaagcagggtcatacctcgtcagtcatggaaattcagaagcagattgagaaaaaggagaaaaagctccataagattcagaataaagcacaaagacagaaggatctcatcatgaaagtggaaaacctgacactcaagaatcattttcagtctgtgctggagcagcttgagttacaggaaaaacaaaaaaatgagaagctcatttccctacaggaacagttgcagcgttttctgaagaagtgaggagagccattggcgtggcccacaaaccttggattcaccatccagactgcagattggatgaaactgtgcacgtttttgtcccttcagttgccttatgttgaatcagttatatttatctgtaccttctttgctacttaaaatatgctcacagtttgtagtcatgtagaaaaggccagtataaaaatgtagtagacttaaagaccccactcgaccatgagactttctctttgtcaatttgggaattattattattaatttagaaatggggtcttgttatgttgcccaggctgaattcagactcctgggcttaagggatccttccgcctcagcctcctgagtagctgggactacagttgtgcaccaccacaccaaacaagaattgattatattgcttctgtgctatggtaccagcagattattcagccatgcttctaaaggcagtctagcctagaggccgtacagctgtttggtttgcatatgttttagcttttcttttggtttttagtatttcctaaaacataggggaaaaaacgaggtcatttctactaagcactaggacctgccatagtgagtttaagtgcctaccttgcagcagttaatactagattgtgttctgtctctgttcaggtaacaggactgcattcctgctcaaggatgattccttgctgctgcttatgttctgttgtttttaggatggagctggttgttattcaccaactaagggaacagttagagcagagatgaagaaattatgaactgttatccttattttgagccttttcctcctaaccctcatcagttaaggttaggaagaacaagatgccataatgcctatgaagacttctttaacaatcttgtttgggtttttttctaggtatattattagtgttttatggtctatgttctttaagcaataaataaattgttcctttt

SEQ ID NO: 67949 - DNA, 901 bp, Homo sapiens
  misc_feature (2)..(3): n is a, c, g, or t
cnngcgttcgcctctacgttccgcgcgggagcccacgcgcggttcgtccggaacccacagaccagagacgcaggtcccagccttttcggtgtcggcgccagttcccggaggagcggacatgagtgaaagccaggatgaagttcctgatgaagttgagaaccagtttatattgcgtctgcctctggaacatgcttgtactgtcaggaacctagcacgttctcaaagtgtcaagatgaaggataaactaaaaattgacttattgcctgatgggcgccatgcagttgttgaagtagaagatgtcccactagctgctaagctggttgacttgccttgtgttattgaaagcctgagaacgcttgataaaaaaaccttttataaaacagcagacatttctcagatgcttgtgtgcactgctgatggtgatatccacctttctccagaagaaccagctgcctctactgatcctaatatagtcaggaaaaaagaaagggggagagaagaaaaatgtgtctggaagcatggcattacgccaccacttaagaatgtcagaaagaaaaggttccggaaaacacaaaaaaaggtccctgatgtcaaagaaatggaaaaaagcagctttactgagtacattgaatctccagacgtggaaaatgaagtaaagagactgctgcgttcggatgctgaagccgtaagtacccgttgggaagtcattgctgaagatggaaccaaggaaatagaaagtcaaggctccatcccaggatttttgatatcctcgggaatgagcagccacaagcagggtcatacctcgtcaggtactttagtaaaggcaaagcaggagtttcagatagggcaggtattgactgggtatcagatcattttccataaattcataggccaatccaaa

SEQ ID NO: 67950 - DNA, 345 bp, Homo sapiens
ctctttcctccccttttatttttaaaataataaataataattttacatattcatgggatacatagtgatattttaatactgtatacaatgtataacaatcaaaccagatatgcattatctcaaaaatttattatttgtgttgtgaacatttaaaatcctttcttctagacttttgacagtatacaataaattatagttagccatattcatcctacagtgctccagaacaccagaactcattcctcctatctagctataattttgtatccattaaccaatccctgcccatcctaagaagcacaatgttaaattgtgctgttaaattattaattacttaattctatc

SEQ ID NO: 67951 - DNA, 750 bp, Homo sapiens
agattgttaaagacaaagcaggacctcataaggaaatctacccccatgtcatcaggaacttagaccaactttaaatgtactgggaatctccactccggaggaactggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaattaggtatttgtttcatgtgtttgcattaataagcagaaaattaagtgctgtattggtttcatggttttgctgccctcttacatgctgagagaactgtgttaattctctggaaaccatctgacatgaaaatcagcttcattaatatgtttgggtgccctagcttgtaaattagctgaaggctagaagtcatttatatagaattttcttgttgacaccctaggcttaggggactggttgtctgtggggatagatcaaatcgtgtacctttccaaaacaggttttaatgatgtttaaaagtggtcactgagatagtcttgaggatgtgctatgcagtagccaagccctcttacggtgtgttcctctcttagtgcccctttcctttcctacctattcttcccttgcagtggtgtattagccttggacattaaaacatttgctttgtaaaaaaa

SEQ ID NO: 67952 - DNA, 300 bp, Homo sapiens
agattgttaaagacaaagcaggacctcataaggaaatctacccccatgtcatcaggaacttagaccaactttaaatgtactgggaatctccactccggaggaactggccttgacaaagtgtaaaccgcatggatgggcttccccaaggatttattgacattgctacttgagtgtgaacagttacctggaaatactgatgataacatattaccttatttgaacaagttttcctttattgagtaccaagccatgtaatggtaacttggactttaataaaagggaaatgagtttgaactgaaa

SEQ ID NO: 67953 - DNA, 262 bp, Homo sapiens
agatgattctgtgagccgtcacaaggaatgaaagcctccagacaacagctgcatgagacagttagaaagaggaccctctagcacctgtcaagtctctagatggcaaaacctgagccagaaccacccagctaagcttctcccaggttcttggctcacaattgctgcgatattaccttatttgaacaagttttcctttattgagtaccaagccatgtaatggtaacttggactttaataaaagggaaatgagtttgaactgaaa

SEQ ID NO: 67954 - DNA, 806 bp, Homo sapiens
atcagcaacagaaaaccaagccagatggactttgcaactaatcaagtttgggatttactgtcttctgaccaaccacagtgactgagatggggctgggaccagaagcccagtgggagtgaacagccgagggaaccagagtctggctgagcttgtggccagatatttaaactgggtccagccacacctgcaaaaccagggcaaggcagtaccgggaaactggctggagttgctgcggtttggggaagttgcacaccctttcatagatacctcccttaaccctcagtgcagattctgagaaaactccaaggcttctctgcctaacctagtataacccctgttccctactacatacatataacttttccattcccccagtaattgacccaaagtccctgcctctagctgtgcccattgtgcaatgatcagaatcccttgtttcaatagtattttgacttctttaagaatactctgtatttggaagctgaaacctcacttggatccattgttgggaaccaagtacggagccttacatagcccggaggagtttcaggagcaatgccactttcccttccatccctccctctgggtactggctcttcccatagtccattttccccttttatctcccattaatttctgtcttcctctctcaccttttccatgtctctagcatcctccaggatttaaaatcatctttacccaacttatctgtgaagtaatggcaaaagaacatctccaaattaagtactccttttcttcaaaggagtttcatgggatgtacagctagtataaaataaaaatatggg

SEQ ID NO: 67955 - DNA, 1776 bp, Homo sapiens
ccaccctggccccccagccagtccagcaatgatggaaaaaaacacctccgagggccctgcctgcagtccagaggagaccgcatctgaatctgccaaggtgcccacagcagagcctcccggagaagtggcagtatcagagtccaccagagaagagcaggtgcccaagccgcacggccctgccccacaggcccctacagcctccacagccactaagcctgcacccccaagtgaagatgtccccagtgccccactgctgctgaccctggatgatgtgagcagcagctctgtgactgtgagctgggagcccccagagaggctggggaggctgggcctccagggctatgtgctggagctctgcagagagggagcctcggagtgggtgcctgtgagtgcccggcccatgatggtgacccagcagactgtgcggaacctggctctgggagacaagttcctcctgcgcgtgtctgcagtgagttctgcaggggctggcccgccggccatgctggaccagcccatccacatccgagagaacattgaggcccccaagatccgtgtcccccgccacctccgtcagacctacatccgccaggtgggagagacggtcaacctgcaaatccccttccaggggaagcctaagcctcaggccacatggacccacaacggccatgccctggacagccagcgggtgagcatgcgcaccggggaccaggactccatcctcttcattcgctcggcccagcgctccgactctggccgctacgagctcactgtgcgcgtggaagacctggaggccaaggcagtcattgacatcctggtgattgagaaacctggaccccccagcagcatcaggctcctggacgtctggggctgcaatgctgctcttcagtggacgccaccccaggacacaggcaacacagagctcctgggctacatggtgcagaaggcagacaaaaagacagggcaatggttcacagtgctggagcgctaccacccaaccacctgcaccatctctgacctcatcatcggcaactcgtactccttccgggtcttctcagaaaacctgtgtggactcagcacctcggccaccgtcaccaaggagctcgcccacatccagaaggcagatattgctgccaaacctaaagggtttattgagcgagacttctcagaagccccctcattcacccagcccctggctgaccacacctccacccctggctacagcacccagttgttctgcagtgtcgagcttcacccaagcccaagatcatctggatgaaaaacaagatggagatccagggcaaccccaaataccgcgccctctctgagcaaggcgtctgcaccctagagatccggaaacccagcccctttgattctggggtctacacctgcaaggccataaatgtgctgggggaggcatctgtggactgccggctggaggtcaaagcctcagccgcacactgaagagtcacgggaggaggctgtgatgaggagccaggtgctgcaggcctgaggggccaggtccaccaggcctacagtcaaactccagagatgcccaagacccccgcttccatagcgacggctgatggaaccgcccctggtacctgctggcctcccttccccagaggctggtgtccagaactcaggaatgggcctggtaggccccaggccagactaactgggctcaaggggtgctggaaggcgcagagattggagtgccctgcggagttgcacactgggtgggaagcactcaaataaagatgcgtggtgttaacagtg

SEQ ID NO: 67956 - DNA, 507 bp, Homo sapiens
gataacaacctttccctgccttccttcccctggtggttctgaggctctgcataagtacggaagtatctagaactgcagtgggcagagctcagacctgggcattgcacctgagggagggaggcctggtgaggaagaggatgctgctccccctccccactctgcacctctctggcctgcagccgagctctgctcacaccaggggctcaggaagcatgtcctcctccaggtgctgcaggcctgaggggccaggtccaccaggcctacagtcaaactccagagatgcccaagacccccgcttccatagcgacggctgatggaaccgcccctggtacctgctggcctcccttccccagaggctggtgtccagaactcaggaatgggcctggtaggccccaggccagactaactgggctcaaggggtgctggaaggcgcagagattggagtgccctgcggagttgcacactgggtgggaagcactcaaataaagatgcgtggtgttaacagtg

SEQ ID NO: 67957 - DNA, 949 bp, Homo sapiens
ccaccctggccccccagccagtccagcaatgatggaaaaaaacacctccgagggccctgcctgcagtccagaggagaccgcatctgaatctgccaaggtgcccacagcagagcctcccggagaagtggcagtatcagagtccaccagagaagagcaggtgcccaagccgcacggccctgccccacaggcccctacagcctccacagccactaagcctgcacccccaagtgaagatgtccccagtgccccactgctgctgaccctggatgatgtgagcagcagctctgtgactgtgagctgggagcccccagagaggctggggaggctgggcctccagggctatgtgctggagctctgcagagagggagcctcggagtgggtgcctgtgagtgcccggcccatgatggtgacccagcagactgtgcggaaccccaagatcatctggatgaaaaacaagatggagatccagggcaaccccaaataccgcgccctctctgagcaaggcgtctgcaccctagagatccggaaacccagcccctttgattctggggtctacacctgcaaggccataaatgtgctgggggaggcatctgtggactgccggctggaggtcaaagcctcagccgcacactgaagagtcacgggaggaggctgtgatgaggagccaggtgctgcaggcctgaggggccaggtccaccaggcctacagtcaaactccagagatgcccaagacccccgcttccatagcgacggctgatggaaccgcccctggtacctgctggcctcccttccccagaggctggtgtccagaactcaggaatgggcctggtaggccccaggccagactaactgggctcaaggggtgctggaaggcgcagagattggagtgccctgcggagttgcacactgggtgggaagcactcaaataaagatgcgtggtgttaacagtg

SEQ ID NO: 67958 - DNA, 313 bp, Homo sapiens
gacagcttaaaatcaaggccgaagagaaggggtggtaagactggggtcaggctgtgctgattactttccaagcggcagggtggacaggtgtagaagagggtgtataaccgtgaactttccagttccccgccacttcccccaagctataactgcagctctaattcagcctcagccgcacactgaagagtcacgggaggaggctgtgatgaggagccaggtaaatggcctgacccacccactctgttacctctgtgggcagcacagaagcagagaggaggccaggagcagggggttagggttttaagggaagggg

SEQ ID NO: 67959 - DNA, 409 bp, Homo sapiens
ctgggcattgcacctgagggagggaggcctggtgaggaagaggatgctgctccccctccccactctgcacctctctggcctgcagccgagctctgctcacaccaggggctcaggaagcatgtcctcctccaggtgctgcaggcctgaggggccaggtccaccaggcctacagtcaaactccagagatgcccaagacccccgcttccatagcgacggctgatggaaccgcccctggtacctgctggcctcccttccccagaggctggtgtccagaactcaggaatgggcctggtaggccccaggccagactaactgggctcaaggggtgctggaaggcgcagagattggagtgccctgcggagttgcacactgggtgggaagcactcaaataaagatgcgtggtgttaac

SEQ ID NO: 67960 - DNA, 1872 bp, Homo sapiens
ccaccctggccccccagccagtccagcaatgatggaaaaaaacacctccgagggccctgcctgcagtccagaggagaccgcatctgaatctgccaaggtgcccacagcagagcctcccggagaagtggcagtatcagagtccaccagagaagagcaggtgcccaagccgcacggccctgccccacaggcccctacagcctccacagccactaagcctgcacccccaagtgaagatgtccccagtgccccactgctgctgaccctggatgatgtgagcagcagctctgtgactgtgagctgggagcccccagagaggctggggaggctgggcctccagggctatgtgctggagctctgcagagagggagcctcggagtgggtgcctgtgagtgcccggcccatgatggtgacccagcagactgtgcggaacctggctctgggagacaagttcctcctgcgcgtgtctgcagtgagttctgcaggggctggcccgccggccatgctggaccagcccatccacatccgagagaacattgaggcccccaagatccgtgtcccccgccacctccgtcagacctacatccgccaggtgggagagacggtcaacctgcaaatccccttccaggggaagcctaagcctcaggccacatggacccacaacggccatgccctggacagccagcgggtgagcatgcgcaccggggaccaggactccatcctcttcattcgctcggcccagcgctccgactctggccgctacgagctcactgtgcgcgtggaagacctggaggccaaggcagtcattgacatcctggtgattgagaaacctggaccccccagcagcatcaggctcctggacgtctggggctgcaatgctgctcttcagtggacgccaccccaggacacaggcaacacagagctcctgggctacatggtgcagaaggcagacaaaaagacagggcaatggttcacagtgctggagcgctaccacccaaccacctgcaccatctctgacctcatcatcggcaactcgtactccttccgggtcttctcagaaaacctgtgtggactcagcacctcggccaccgtcaccaaggagctcgcccacatccagaaggcagatattgctgccaaacctaaagggtttattgagcgagacttctcagaagccccctcattcacccagcccctggctgaccacacctccacccctggctacagcacccagttgttctgcagtgtcgagcttcacccaagcccaagatcatctggatgaaaaacaagatggagatccagggcaaccccaaataccgcgccctctctgagcaaggcgtctgcaccctagagatccggaaacccagcccctttgattctggggtctacacctgcaaggccataaatgtgctgggggaggcatctgtggactgccggctggaggtcaaagcctcagccgcacactgaagagtcacgggaggaggctgtgatgaggagccaggtgctgcaggcctgaggggccaggtccaccaggcctacagtcaaactccagagatgcccaagacccctggctacagcacccagttgttctgcagtgtccgagcttcacccaagcccaagatcatctggatgaaaaacaagatggagatccagggcaaccccaaataccgcgccctctctgagcaaggcgtctgcaccctagagatccggaaacccttccccagaggctggtgtccagaactcaggaatgggcctggtaggccccaggccagactaactgggctcaaggggtgctggaaggcgcagagattggagtgccctgcggagttgcacactgggtgggaagcactcaaataaagatgcgtggtgttaacagtg

SEQ ID NO: 67961 - DNA, 325 bp, Homo sapiens
  misc_feature (38)..(38): n is a, c, g, or t
  misc_feature (127)..(127): n is a, c, g, or t
tggggagcctgaggcatgagaatcgcttgagccctggnggtggaggttgcagtgagctgagaccccgtcactgaactccagcctgggtgacagagcaagactctgtatcaaaaaaacaaacaaacanacaaacaaaaaagcctattataaaacaataggaaatgcctgaagtctagtgcaccaagacatactgaatttcaaactaaataaattaaaattaccatgtacattccactacatgtcaaaacaggaaaaaccatagtattatagttgatatgaaatgaagattacatacaacagtaatacagagaaaacatgaagctgc

SEQ ID NO: 67962 - DNA, 281 bp, Homo sapiens
gtaaaatgtaaaatatgtacacaaataaattaaatagtgtaataataaataaacctgtatgttactcatttctaaaatagcttttataacaatgaacaaatggcaaccttggttggtatatacatttacctacttcctacattcttaatcttaaaaaaaatatgttatttataaaaatttaataattattctaaattgattaccaactggcttccattgttagaaaggcaaacctttcagccaactacataactttcagagtcaattaaatttacagaaag

SEQ ID NO: 67963 - DNA, 4629 bp, Homo sapiens
tcacttgcctgatatttccagtgtcagagggacacagccaacgtggggtcccttctaggctgacagccgctctccagccactgccgcgagcccgtctgctcccgccctgcccgtgcactctccgcagccgccctccgccaagccccagcgcccgctcccatcgccgatgaccgcggggaggaggatggagatgctctgtgccggcagggtccctgcgctgctgctctgcctgggtttccatcttctacaggcagtcctcagtacaactgtgattccatcatgtatcccaggagagtccagtgataactgcacagctttagttcagacagaagacaatccacgtgtggctcaagtgtcaataacaaagtgtagctctgacatgaatggctattgtttgcatggacagtgcatctatctggtggacatgagtcaaaactactgcaggtgtgaagtgggttatactggtgtccgatgtgaacacttctttttaaccgtccaccaacctttaagcaaagagtatgtggctttgaccgtgattcttattattttgtttcttatcacagtcgtcggttccacatattatttctgcagatggtacagaaatcgaaaaagtaaagaaccaaagaaggaatatgagagagttacctcaggggatccagagttgccgcaagtctgaatggcgccatcaaacttatgggcagggataacagtgtgcctggttaatattaatattcccattttattaataatatttatgttgggtcaagtgttaggtcaataacactgtattttaatgtacttgaaaaatgtttttatttttgttttatttttgacagactatttgctaatgtataatgtgcagaaaatatttaatatcaaaagaaaattgatatttttatacaagtaatttcctgagctaaatgcttcattgaaagcttcaaagtttatatgcctggtgcacagtgcttagaagtaagcaattcccaggtcatagctcaagaattgttagcaaatgacagatttctgtaagcctatatatatagtcaaatcgatttagtaagtatgttttttatgttcctcaaatcagtgataattggtttgactgtaccatggtttgatatgtagttggcaccatggtatcatatattaaaacaataatgcaattagaatttgggagaagcaaatataggtcctgtgttaaacactacacatttgaaacaagctaaccctggggagtctatggtctcttcactcaggtctcagctataattctgttatatgaggggcagtggacagttccctatgccaactcacgactcctacaggtactagtcactcatctaccagattctgcctatgtaaaatgaattgaaaaacaattttctgtaatcttttatttaagtagtgggcatttcatagcttcacaatgttccttttttgtatattacaacatttatgtgaggtaattattgctcaacagacaattagaaaaaagtccacacttgaagcctaaatttgtgctttttaagaatatttttagactatttctttttataggggctttgctgaattctaacattaaatcacagcccaaaatttgatggactaattattattttaaaatatatgaagacaataattctacatgttgtcttaagatggaaatacagttatttcatcttttattcaaggaagttttaactttaatacagctcagtaaatggcttcttctagaatgtaaagttatgtatttaaagttgtatcttgacacaggaaatgggaaaaaacttaaaaattaatatggtgtatttttccaaatgaaaaatctcaattgaaagcttttaaaatgtagaaacttaaacacaccttcctgtggaggctgagatgaaaactagggctcattttcctgacatttgtttattttttggaagagacaaagatttcttctgcactctgagcccataggtctcagagagttaataggagtatttttgggctattgcataaggagccactgctgccaccacttttggattttatgggaggctccttcatcgaatgctaaacctttgagtagagtctccctggatcacataccaggtcagggaggatctgttcttcctctacgtttatcctggcatgtgctagggtaaacgaaggcataataagccatggctgacctctggagcaccaggtgccaggacttgtctccatgtgtatccatgcattatataccctggtgcaatcacacgactgtcatctaaagtcctggccctggcccttactattaggaaaataaacagacaaaaacaagtaaatatatatggtcctatacatattgtatatatattcatatacaaacatgtatgtatacatgaccttaatggatcatagaattgcagtcatttggtgctctgctaaccatttatataaaacttaaaaacaagagaaaagaaaaatcaattagatctaaacagttatttctgtttcctatttaatatagctgaagtcaaaatatgtaagaacacattttaaatactctacttacagttggccctctgtggttagttccacatctgtggattcaaccaaccaaggacggaaaatgcttaaaaaataatacaacaacaacaaaaaatacattataacaactatttacttttttttttttctttttgagatggagtctcgctctgttgcccaggttggagtgcagtggcacgatctcggctcactgcaacctcacctcccgggttcaagagatcctcctgcctcagcctcctgagcagctgggactacaggcgcatgccaccatgcccagctaatttttgtatttttagtagaggcggggtttcaccatgttggccaggatggtctcaatctcctaaccttgagatccaccctccacagcctcccaaactgctgggattacaggcgtgagccaccgcacgtagcatttacattaggtattacaagtaatgtaaagatgatttaagtatacaggaggatgtgaataggttatatgcaagcactatgcccttttatataagtgacttgaacatctgtgcccgattttagtatgtgcaggggggcgatctgggaatcagtcccctgtggataccaaggtacaactgtatttattaacgcttactagatgtgaggagagtctgaatattttcagtgatcttggctgtttcaaaaaaatctattgacttttcaataaatcagctgcaatccatttatttcatttacaaaagatttattgtaagcctctcaatcttggtttttcagttgatcttaagcatgtcaattcataaaaacaagtcatttttgtatttttcatctttaagaatgcttaaaaaagctaatccctaaaatagttagatctttgtaaatgcatattaaataataaagtatgacccacattactttttatgggtgaaaataagacaaaaataatagttttagtgaggatggtgctgagtaaacataaaaactgatttgctctcagctgatgtgtcctgtacacagtgggaagattttagttcacacttagtctaactcccccattttacagatttctcactatatatatttctagaaggggctatgcatattcaatgtattgagaaccaaagcaaccacaaatgcataaatgcataatttatggtcttcaaccaaggccacataataacccagttaacttactctttaaccaggaatattaagttctataactagtactcaaggtttaaccttaaaattaagatttccttaaccttaaccttaaaattgatattatattaaacatacataatacaatgtaactccactgttctcctgaatattttttgctctaatctctctgccgaaagtcaaagtgatgggagaattggtatactggtatgactacgtcttaagtcagatttttatttatgagtctttgagactaaattcaatcaccaccaggtatcaaatcaacttttatgcagcaaatatatgattctagtgtctgacttttgttaaattcagtaatgcagtttttaaaaacctgtatctgacccactttgtaatttttgctccaatatccattctgtagacttttgaaaaaaaagtttttaatttgatgcccaatatattctgaccgttaaaaaattcttgttcatatgggagaagggggagtaatgacttgtacaaacagtatttctggtgtatattttaatgtttttaaaaagagtaatttcatttaaatatctgttattcaaatttgatgatgttaaatgtaatataatgtattttctttttattttgcactctgtaattgcactttttaagtttgaagagccattttggtaaacggtttttattaaagatgctatggaacataaagttgtattgcatgcaatttaaagtaacttatttgactatgaatattatcggattactgaattgtatcaatttgtttgtgttcaatatcagctttgataattgtgtaccttaagatattgaaggagaaaatagataatttacaagatattattaatttttatttatttttcttgggaattgaaaaaaattgaaataaataaaaatgcattgaacatcttgcattcaaaatcttcactgaca

SEQ ID NO: 67964 - DNA, 446 bp, Homo sapiens
caaccaccttcttcccccacaactcccacccaaaggcagggatttttgactttttttgccctctgctttatattcagtgcctaaaacaggccttgcacacagttggccactaactgaatacatactgaaagaatggtttcctgtgtcatcttagctaggcaagagtgcctggtaatttaatggaacactgatctaggcattactgcgatggcatttgttacatgtgattcatatctacagtaaggtgactttcagaaaggacattgctcttgaccaggctccatggctggctcacgcctgcaatcccagcactttgggaggcagaggtgggcggatcacctgaggtcaggagttcaagactagcctggccaacatggtgaaaccccatctctactaaaaatacaaaaattaactgggcatggtagtgggcatctgtagtcccagct

SEQ ID NO: 67965 - DNA, 2093 bp, Homo sapiens
  misc_feature (1)..(1): n is a, c, g, or t
  misc_feature (1022)..(1022): n is a, c, g, or t
  misc_feature (1160)..(1160): n is a, c, g, or t
  misc_feature (1294)..(1294): n is a, c, g, or t
  misc_feature (1951)..(1951): n is a, c, g, or t
nggtgtcatggggacactttcatggactcctcacttcaggaccctcttactgggtttctcacacccctttcatagtttatcttttcgccgcttttctgtaatcatatcagagactgatgattgttggtgactgcttttgttgctgtgattagaatcacagagcagaagaagcaccactaaccagtggaagcatctcagtgcagagcacagaagtatgactgcaatatacacgaaatagaactagaatgcctagttctgtaagtatatcacacactaggacacaggtatgtgtgagaaccccgcattatgaagatcagccattagaaaaccactgtgtaaaaggatccactcaagataagagcagctgccatttggagaaattgaaaaaggtatgaaatcagaaagtcagatcacagaagagaatatatgtttacttccaaatttaaattttaaaagtgtgatggctatattaaaagtgcaatttacttaactgtcctgcttaaagctttggggtaattgtctaggtggatcttaagtgtatttctcagttcaaacaagcaatagtttcccaggtgaattgagaagggatcagaacctaaggtcagggagattcattctgaaaaaaaagattcatatgtgggaaacacccctatttttttcccactgggacacaggggtgcacacctggtcatctctaagtggcagtaacacatatgaagcagacccttgtggtactgaaatgtattaacccaaagacctgtcaccacatactcgagcatccagactgaaatacttagagagatcagcttccaacagaattaaaaggtagatcccaaggatccattttgagcaccttttttcagcctttagttttaactggaaatgtagggactgtgagttactgtctcatattttgaaatgaaggtcttttgtttgaggaatttgcatttcatcgtagaaaccacgttcttggtttagttactttctaccaaaggaagttcttcctgtgttttgcaagtagnatgaagaacctaacagactccaatttaaaaagaatatcagagatatataattacactggtttaaaagaaatggggaatctaatttcagattgccacatgatgagagctgttgaagtcgttatcacggtatctgagttngtcacctagatcacatataatagattctcaaatagattttaaatcagttataatagtaattaagactttgttgagcatcccaagtaaagacaggatacttcatatttcgtatgagttaaaatcttaatattaanaaaatgtatataacttgtcttaagacctagaaaaaagcattgttgacatatttaggcctgtaataaaataaagccacttctttgtaggttattttgaagatgcatgttacctagaagttttcataagccaagccttagcctcacagcactttactttcatgaaaaagatttaaaagaattaagaaattgtaaggacttctagagaggtgcatgccttattttctaagccattaaaggtatacaattctatgattcacaggcaaagaaacccaaagtagtttatatatttattaggaaaatacctgggacatatttacataaagagggatggaaaatgtgtgacaaatttgacatttaaaaaaattaagatttacattgtaatgacagcagtgattcaggttgtaaagattgatttacagtggattaaaattctgcttagatagtctttatctagaaccaggaaattcaactttcagaaagtcattttctgattcctatttagggagaagtaagatgaaccaaaaaaaatatgtggtaacccaaaacagtaacaaaagaaacctccttggtgacctaaataactgtatatgaaaataataatgtcatctgatatggaaacatgtaaccgaaaactttaaaatcaacaagtgaagacanatagtacccatgaataatgtttaatgctgtggttttttgtggatttttttctgtcactaaaatggaatatttttctcactgctgcactctcttgtcatctagctctgccaaatttttggctattaaatctctgaatcaactc

SEQ ID NO: 67966 - DNA, 444 bp, Homo sapiens
gtcccatctgcccctttctgggcttagcaaagtcagggctgctgaccccatccctcctagggagccaattgatggcgcagagcacaaggtagccaggagacaaaaggttctggaaggaaggccaaggacactggcatggagcaggctggcagtgccctcagctgctggaggagtgagagcccagactgcctgtgtggccgtcatgagggtcttcacaagctgaccaggacccttcagcaggtccaaacttgtatgaagctacacaagcagccactcctgctgcccccaggaggatactacccccaggttgagaacaaagccttcaaaaacaggaactgcatcttctccctcttcatatttctctgcagaactccgcacacagtatgtccttaataaatcccagctggagggagccccacctcaggcttttcagaaacacagcag

SEQ ID NO: 67967 - DNA, 1225 bp, Homo sapiens
  misc_feature (76)..(76): n is a, c, g, or t
ctccagccctcattcttcatgcctcatttgcctgggagacgttcgccacttctcttgtgccttgcggtccgttccntcataatgaatggatccaatatggcaaatacatcaccgagtgtaaaatccaaagaggaccaggggttaagtgggcacgatgaaaaggaaaacccatttgcagagtacatgtggatggagaatgaagaggatttcaacagacaggtggaggaggaactgcaggagcaagacttcttggaccgctgcttccaagagatgctggatgaagaagaccaagactggtttattccatcacgagacctgcctcaggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcacaaaatggtggagctgaagagggggatggggcgggcgaggggtgcacagcgggaaggggagtggtggtctcacgatactgtgactctgagtaactaatatgctcagtcttattctaaaaaaaaagacaagcaacacataaacaacgacaaaagtagaacacaaaagaacagaacgcagaacagaaaagaacgaagacaaaagcacgccaacagaagagaacacagagagaaagaggagtcagcaaaaacgaccaaacacgtagagaagagagtaacaagagcgacgcggacaaaaacagagagacgcagaagaaactgcaacaaaccaacgaccgaaagacgacagagggacgaaaccacaccgactgacagacacacccaatccaggagggccggcgatcccaagacgacggagacaacaagaaaaggggtcgagcggagaagaagcagaaaccgcggggacgcgcaaccgagacacgcaacaaccggagggagcgcagagaagaagaaaccaaagacatacggagaagaacaacacaaccgagaccaagactgaacacgcgtgctaaacaagcataaacgcaacgaagacaaaacaacagaaaaaacagaacggacaagacaaaccaaggaagacaagcaggcaagcgcagaaacaaaagaaaacagacacgacacacgacacgaccacagaccaatgggacagaaagccaaaa

SEQ ID NO: 67968 - DNA, 6201 bp, Homo sapiens
  misc_feature (76)..(76): n is a, c, g, or t
ctccagccctcattcttcatgcctcatttgcctgggagacgttcgccacttctcttgtgccttgcggtccgttccntcataatgaatggatccaatatggcaaatacatcaccgagtgtaaaatccaaagaggaccaggggttaagtgggcacgatgaaaaggaaaacccatttgcagagtacatgtggatggagaatgaagaggatttcaacagacaggtggaggaggaactgcaggagcaagacttcttggaccgctgcttccaagagatgctggatgaagaagaccaagactggtttattccatcacgagacctgcctcaggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcacaaaatggtggagctgaagagggggatggggcgggcgaggggtgcacagcgggaaggggagtggtggtctcacgatactgtgactctgagtaactaatatgctcagtcttattctaagcctctgagtatttctattttgttctgctgacttttgtttggggagtttcctgttttgtttttttaaatagctctttcgagttaaggaaattgcattttccccccttcatcagaagtgttccgcggtgtgtatttaaacaaaataagctgactaagaaaaactggatatttaggaaatgcccctctcaccctgctgtatacttatcagggacagtgagcacctggagagctttttgtggaatctattgagttggatgggaaaagggacaagcagaaagagcaggtggtgcaaactggaatttgaggctcagctgccccacccccggggtctcctgcaatgaactcggataaccaatgtgctgtcaagcccttgcctgtttgtcctgaaccccattcaagaaaacacagacttaaagtacttagtttacagtaacttttgatgattgttgaaagttgtaaatcagaaggtagggctgtgatggtggttgtcacttgagtcatttagttactgttgtcctgttcataagcctgtgttcaccaccaccatcagactcaccatttataagtagaagagcactagggttgatctgccacctcatctttcatgaagtctattccccagcctcctttttaagaaaagatactgctaccaaaggcataggggaggcctgctgtgctggcaattagcatgagcctgcagaagtcatccttgaatctgttgtgtcttaattttatttggacagtttttttttccagcctcatcaacacttggtcttcctggtgtcttaattccctcagacaagtttatgcacttttttaaggaaatatttttcaggacactagtaagaagctcagttcacagtttggatatttcttcccacattacagaattatggaaaggaactcaaaatcagcctaggaaagtgagtcctgcttgacccatgtgactgtgtacctgaccttctgggatcttttcagctattaaaacattttactgttcccacatacccagctttgcaagttttgtagattgacctcttagggtgtgtttctttgtctttcctgcctttaacttgctggggtcttttgttgctacccctaaggaactaaactgggtgccaggagctaccttcgtgtatagagatgtagatggcagtgtggggtacaggagagccatccaggccattctcccagggatgaggaattggagagccctgaagataatagtggcttctttctgattgctactgtgctgtgtgataggcctaatagggaaaagatatgtaacttgaaacaaagttggtataaattcagtatgtggctgtgggacagaggttggaaggaaaggactagggtatggaaagctgaagaaattctccttatgagctctcgttgactttttgaacagtgataagctaatgccagatttaaaatacacattttttcctatttgagtctttaggattatatcatttgaaaaaattgccttccttgttaggtcacatgtcataggagagtagcttagagaacttgcattaccagacagacacattaattcccaaagcctctatgttgagagaatgaaactgttaactctttttcagagaggactatgaataaagaaacttctttattcaagcttcagctttcagctgggttgtttcctctaaaagggaaagggcattgcaagtgcatagaggaaatctctcccttctgggactgcttttcctccttcatcctcgtgagcctgtccaagctcagaattccgaaggctgttagaaatgcgttgggattgcagagagaaaggagcttgtctttccttctgctgtgctggtctgttttggatgtcagtcttcaggactatgaaaacttcctgccagtttagcatggacactgagggctggcatttctagtcttcttcagacactgaacatactgactccaggtataggaagcagctagcaaattgattcttttttaaatgcataggactctgcttccggcggttcctcttgtagtccaactctttttgccatctatttatgttgggaggtaggggcacaattgtcactcacaacacaggctagttagagtttgctaccttcttagcagaaaatgcatgtgtgtcttgttggaccttcactggggaaaggctgggagcctctggctgtcagtgacttttctcacagaagaagaaccagcaagccagactggacacctttaccctttaatggtaagacttgtatttataaggggtaattttgatgttgaatttaagccactactttgtttaaacttttttaaattggcaactagaagtttgagaatttgtatagaaatggaacatgtatttctaacagttgccaatctggctggtcccaatgttagtttattagtgattgatctgtaattattgggattatttattcaactctaaaattccaagatgaaaataatttatctctttcttttcaagggaaaaaacccaaatgaatgcattttcagtttctccaggcctttgaactgcagcagaaaattcaaggatacagcctaggcctgggcaaatgcagccctgggtctttgggccagtttctgacaataatagttgagttttgggaatcacataagggtgaaaccagaaacgatcctaaggaaaggcttgacctttgttaacacctttagtttccaaagtcacagcagctggggtccctcttttttttttttttttctttttttttgagacatagtctcactctgtcacccaggctggagtgcagtggtatgaccatagctcactgcagcatcaaattcctaggctcaagcaatcctcccatcttagcctcccgagtagctgggacaacaggtacgcaccaccacggccagctaattatttttattatttttattttttgtagagactggatcttgctctatttcccaagctactcttgaattgttgtgctcaagtgattctcccatctcagcctcccaaagtgctgggattataggctgggtgtggtgagccaccccagcctggggtctctttaattaaggttataatgctaaccatggcttaaaatactaagcaacattttccaaattgtttattactattgctttgattttggagaagctgggaagtaaggaggtgaggtgaatactctgataattaacacgtgttagagaggaaagttgtgtgaagaggctgccaaagtaaacagcacgaatgaatcttcttgtactagggctgctgcaaaccccaggtagacaaatgacagcccaggctcctgaaccatcaggaacccaggaatctacccaactgtgaggagggggcaggccttcgtcaataagggtcccaccatcacgggctaataatctttctcagtttaggtgatattgaggtattgaaactgttagaaatctgacagatttgaccaagatttggagacgtccacataattgggaaggactgagtgtccctagccactctcctctgggataacgcggacgtcattagtttgcgaagtgggtggggagaacaggaggattgactctaatttggtgtgtagtgggggccttgatgtccttctgcctctgtccacatttccccatgtgactcattgcaccctgcattgctcacagggatcattagttctcccggtagacagagcacctctgcagcctctgctctgctgccttgtgaatttcctacacagacttggttagttacaatttggaaacagtttttttgggtttttttcctttgttttaatcttctcacaatgaagctgctattggtgacagggacaggggagcaggaagccaacccagggaaacatgcgagtttcctgcacaccacttagtcacctgccctcactggccaaccccctactgctgttcccagtcagtctggtttttagaggcatcgtggcaatagaatagctggatacactaatctctacaaggtgtcaggcaggagattcaccttccccagtcccaggggacaggagagaaatctgtaaagggacagatgcaccatctttatttcaaaagaaaaagctccctcagattgtgttactaggagtctcttttgtgacatttactgacctttctccccaatcttaccttcctattggctactttttaaataaaaataaacattttaggctaatatgacaaaaatgagataaaatcttaaaaacattgtactagtgtacagttactaaaatgtgcttactacaaaacagtaaaatatttcactctgtaaatcatcactaagtagttattctgtcctgttgattatgagcctccaaaaatgtttaatgcttgaaggatggtttgggaggcagggaatccttttcttaaaacaactttaatgaggcatatgttacatatcataaaacacccatttcaagtgtacatttcagtgattttagtaacttccctcagtggtgtagctgtaactattactcagttttagaacatttttatccctcccaataagatccttcatgctcttttacagttaatcctgttcttacccccggcaaccactaatctactttctctataaatttgccctttctggacagttcaaatcaatggaatcatacaatatgtggtcccttgggtctggcttttttacttagctaatgtttttgaggtttgtccatgacagataacgtcttggtagtttgttccttttattgctgagtagaattctgttgatggatgtaccacattttgtcagcagagagccttttaaacttggattccaacttcctgttgtctaaacggaaccctccgaacgtaggacttataggggaagctgctgtgcatgtcaaaaaaactactaatcagaatgagctttgtcatccagagccagaactgctgcagaaatttttataattttgcaacttctttttttacaaggaacttttgtgctactacacatcaggacttttgaagcatccaataaatccatttaataagtatgagcatgtgtctgagtggacaagaaagtgaaaccatccatgctacattggataatttttcctcccccagactggatagggaatctcaactttcaaaatagagtatcctggctccatttacaaagctgcacaggtattaaagatcgtgctgcctttgttaggcagatttggaggggaggcccaacagcaaagatggagaggaaaaagggagtggagcttgtggaacaggaagccccccagggtctgtgcagggctgctcagctcttgaggatgttgtggatggtgaagtggtgatggtgtcctggagcagcccagcacctccactgggcccagaaggtcttgacttcggacacttacccctgtttcacaagtgtttataaagctgtttttgcttttgtttttctcctaaataatccttacttggtagttattaatccttctttgggggagggacagggctttaaaactgaagaaaataattttcataaaaatatcaaaaatggaaaaaagttactttgtaaaaaatttgctatacaaaccaaatggcagctgttgagaatctcaataaaatgttaaatgca

SEQ ID NO: 67969 - DNA, 6489 bp, Homo sapiens
  misc_feature (162)..(162): n is a, c, g, or t
ctggcaagtggtagtggcgcttctcgggtgctgtgcttcacgttttggtactaaaggccgagactgttgtggcgacggcgacctctacggcaacggcttaagctctcggaggagtggcagagtacgatctgaaggaggggcttctggttagcccaggttccntcataatgaatggatccaatatggcaaatacatcaccgagtgtaaaatccaaagaggaccaggggttaagtgggcacgatgaaaaggaaaacccatttgcagagtacatgtggatggagaatgaagaggatttcaacagacaggtggaggaggaactgcaggagcaagacttcttggaccgctgcttccaagagatgctggatgaagaagaccaagactggtttattccatcacgagacctgcctcaggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcacaaaatggtggagctgaagagggggatggggcgggcgaggggtgcacagcgggaaggggagtggtggtctcacgatactgtgactctgagtaactaatatgctcagtcttattctaagcctctgagtatttctattttgttctgctgacttttgtttggggagtttcctgttttgtttttttaaatagctctttcgagttaaggaaattgcattttccccccttcatcagaagtgttccgcggtgtgtatttaaacaaaataagctgactaagaaaaactggatatttaggaaatgcccctctcaccctgctgtatacttatcagggacagtgagcacctggagagctttttgtggaatctattgagttggatgggaaaagggacaagcagaaagagcaggtggtgcaaactggaatttgaggctcagctgccccacccccggggtctcctgcaatgaactcggataaccaatgtgctgtcaagcccttgcctgtttgtcctgaaccccattcaagaaaacacagacttaaagtacttagtttacagtaacttttgatgattgttgaaagttgtaaatcagaaggtagggctgtgatggtggttgtcacttgagtcatttagttactgttgtcctgttcataagcctgtgttcaccaccaccatcagactcaccatttataagtagaagagcactagggttgatctgccacctcatctttcatgaagtctattccccagcctcctttttaagaaaagatactgctaccaaaggcataggggaggcctgctgtgctggcaattagcatgagcctgcagaagtcatccttgaatctgttgtgtcttaattttatttggacagtttttttttccagcctcatcaacacttggtcttcctggtgtcttaattccctcagacaagtttatgcacttttttaaggaaatatttttcaggacactagtaagaagctcagttcacagtttggatatttcttcccacattacagaattatggaaaggaactcaaaatcagcctaggaaagtgagtcctgcttgacccatgtgactgtgtacctgaccttctgggatcttttcagctattaaaacattttactgttcccacatacccagctttgcaagttttgtagattgacctcttagggtgtgtttctttgtctttcctgcctttaacttgctggggtcttttgttgctacccctaaggaactaaactgggtgccaggagctaccttcgtgtatagagatgtagatggcagtgtggggtacaggagagccatccaggccattctcccagggatgaggaattggagagccctgaagataatagtggcttctttctgattgctactgtgctgtgtgataggcctaatagggaaaagatatgtaacttgaaacaaagttggtataaattcagtatgtggctgtgggacagaggttggaaggaaaggactagggtatggaaagctgaagaaattctccttatgagctctcgttgactttttgaacagtgataagctaatgccagatttaaaatacacattttttcctatttgagtctttaggattatatcatttgaaaaaattgccttccttgttaggtcacatgtcataggagagtagcttagagaacttgcattaccagacagacacattaattcccaaagcctctatgttgagagaatgaaactgttaactctttttcagagaggactatgaataaagaaacttctttattcaagcttcagctttcagctgggttgtttcctctaaaagggaaagggcattgcaagtgcatagaggaaatctctcccttctgggactgcttttcctccttcatcctcgtgagcctgtccaagctcagaattccgaaggctgttagaaatgcgttgggattgcagagagaaaggagcttgtctttccttctgctgtgctggtctgttttggatgtcagtcttcaggactatgaaaacttcctgccagtttagcatggacactgagggctggcatttctagtcttcttcagacactgaacatactgactccaggtataggaagcagctagcaaattgattcttttttaaatgcataggactctgcttccggcggttcctcttgtagtccaactctttttgccatctatttatgttgggaggtaggggcacaattgtcactcacaacacaggctagttagagtttgctaccttcttagcagaaaatgcatgtgtgtcttgttggaccttcactggggaaaggctgggagcctctggctgtcagtgacttttctcacagaagaagaaccagcaagccagactggacacctttaccctttaatggtaagacttgtatttataaggggtaattttgatgttgaatttaagccactactttgtttaaacttttttaaattggcaactagaagtttgagaatttgtatagaaatggaacatgtatttctaacagttgccaatctggctggtcccaatgttagtttattagtgattgatctgtaattattgggattatttattcaactctaaaattccaagatgaaaataatttatctctttcttttcaagggaaaaaacccaaatgaatgcattttcagtttctccaggcctttgaactgcagcagaaaattcaaggatacagcctaggcctgggcaaatgcagccctgggtctttgggccagtttctgacaataatagttgagttttgggaatcacataagggtgaaaccagaaacgatcctaaggaaaggcttgacctttgttaacacctttagtttccaaagtcacagcagctggggtccctcttttttttttttttttctttttttttgagacatagtctcactctgtcacccaggctggagtgcagtggtatgaccatagctcactgcagcatcaaattcctaggctcaagcaatcctcccatcttagcctcccgagtagctgggacaacaggtacgcaccaccacggccagctaattatttttattatttttattttttgtagagactggatcttgctctatttcccaagctactcttgaattgttgtgctcaagtgattctcccatctcagcctcccaaagtgctgggattataggctgggtgtggtgagccaccccagcctggggtctctttaattaaggttataatgctaaccatggcttaaaatactaagcaacattttccaaattgtttattactattgctttgattttggagaagctgggaagtaaggaggtgaggtgaatactctgataattaacacgtgttagagaggaaagttgtgtgaagaggctgccaaagtaaacagcacgaatgaatcttcttgtactagggctgctgcaaaccccaggtagacaaatgacagcccaggctcctgaaccatcaggaacccaggaatctacccaactgtgaggagggggcaggccttcgtcaataagggtcccaccatcacgggctaataatctttctcagtttaggtgatattgaggtattgaaactgttagaaatctgacagatttgaccaagatttggagacgtccacataattgggaaggactgagtgtccctagccactctcctctgggataacgcggacgtcattagtttgcgaagtgggtggggagaacaggaggattgactctaatttggtgtgtagtgggggccttgatgtccttctgcctctgtccacatttccccatgtgactcattgcaccctgcattgctcacagggatcattagttctcccggtagacagagcacctctgcagcctctgctctgctgccttgtgaatttcctacacagacttggttagttacaatttggaaacagtttttttgggtttttttcctttgttttaatcttctcacaatgaagctgctattggtgacagggacaggggagcaggaagccaacccagggaaacatgcgagtttcctgcacaccacttagtcacctgccctcactggccaaccccctactgctgttcccagtcagtctggtttttagaggcatcgtggcaatagaatagctggatacactaatctctacaaggtgtcaggcaggagattcaccttccccagtcccaggggacaggagagaaatctgtaaagggacagatgcaccatctttatttcaaaagaaaaagctccctcagattgtgttactaggagtctcttttgtgacatttactgacctttctccccaatcttaccttcctattggctactttttaaataaaaataaacattttaggctaatatgacaaaaatgagataaaatcttaaaaacattgtactagtgtacagttactaaaatgtgcttactacaaaacagtaaaatatttcactctgtaaatcatcactaagtagttattctgtcctgttgattatgagcctccaaaaatgtttaatgcttgaaggatggtttgggaggcagggaatccttttcttaaaacaactttaatgaggcatatgttacatatcataaaacacccatttcaagtgtacatttcagtgattttagtaacttccctcagtggtgtagctgtaactattactcagttttagaacatttttatccctcccaataagatccttcatgctcttttacagttaatcctgttcttacccccggcaaccactaatctactttctctataaatttgccctttctggacagttcaaatcaatggaatcatacaatatgtggtcccttgggtctggcttttttacttagctaatgtttttgaggtttgtccatgacagataacgtcttggtagtttgttccttttattgctgagtagaattctgttgatggatgtaccacattttgtcagcagagagccttttaaacttggattccaacttcctgttgtctaaacggaaccctccgaacgtaggacttataggggaagctgctgtgcatgtcaaaaaaactactaatcagaatgagctttgtcatccagagccagaactgctgcagaaatttttataattttgcaacttctttttttacaaggaacttttgtgctactacacatcaggacttttgaagcatccaataaatccatttaataagtatgagcatgtgtctgagtggacaagaaagtgaaaccatccatgctacattggataatttttcctcccccagactggatagggaatctcaactttcaaaatagagtatcctggctccatttacaaagctgcacaggtattaaagatcgtgctgcctttgttaggcagatttggaggggaggcccaacagcaaagatggagaggaaaaagggagtggagcttgtggaacaggaagccccccagggtctgtgcagggctgctcagctcttgaggatgttgtggatggtgaagtggtgatggtgtcctggagcagcccagcacctccactgggcccagaaggtcttgacttcggacacttacccctgtttcacaagtgtttataaagctgtttttgcttttgtttttctcctaaataatccttacttggtagttattaatccttctttgggggagggacagggctttaaaactgaagaaaataattttcataaaaatatcaaaaatggaaaaaagttactttgtaaaaaatttgctatacaaaccaaatggcagctgttgagaatctcaataaaatgttaaatgcatttgctggcagtggtacccttttgcctaaggttgggtcactgtgttataccgtgtgtgtttggggtggggggaggtgtgaaactttttgtctcacacataagttgtctcatgggtcataatcttagttgcagttttcctttcaaatagggttgcaaagtagaaaacatgggcttggaagtgacagacctgagtgaatcccac

SEQ ID NO: 67970 - DNA, 6213 bp, Homo sapiens
  misc_feature (162)..(162): n is a, c, g, or t
ctggcaagtggtagtggcgcttctcgggtgctgtgcttcacgttttggtactaaaggccgagactgttgtggcgacggcgacctctacggcaacggcttaagctctcggaggagtggcagagtacgatctgaaggaggggcttctggttagcccaggttccntcataatgaatggatccaatatggcaaatacatcaccgagtgtaaaatccaaagaggaccaggggttaagtgggcacgatgaaaaggaaaacccatttgcagagtacatgtggatggagaatgaagaggatttcaacagacaggtggaggaggaactgcaggagcaagacttcttggaccgctgcttccaagagatgctggatgaagaagaccaagactggtttattccatcacgagacctgcctcaggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcacaaaatggtggagctgaagagggggatggggcgggcgaggggtgcacagcgggaaggggagtggtggtctcacgatactgtgactctgagtaactaatatgctcagtcttattctaagcctctgagtatttctattttgttctgctgacttttgtttggggagtttcctgttttgtttttttaaatagctctttcgagttaaggaaattgcattttccccccttcatcagaagtgttccgcggtgtgtatttaaacaaaataagctgactaagaaaaactggatatttaggaaatgcccctctcaccctgctgtatacttatcagggacagtgagcacctggagagctttttgtggaatctattgagttggatgggaaaagggacaagcagaaagagcaggtggtgcaaactggaatttgaggctcagctgccccacccccggggtctcctgcaatgaactcggataaccaatgtgctgtcaagcccttgcctgtttgtcctgaaccccattcaagaaaacacagacttaaagtacttagtttacagtaacttttgatgattgttgaaagttgtaaatcagaaggtagggctgtgatggtggttgtcacttgagtcatttagttactgttgtcctgttcataagcctgtgttcaccaccaccatcagactcaccatttataagtagaagagcactagggttgatctgccacctcatctttcatgaagtctattccccagcctcctttttaagaaaagatactgctaccaaaggcataggggaggcctgctgtgctggcaattagcatgagcctgcagaagtcatccttgaatctgttgtgtcttaattttatttggacagtttttttttccagcctcatcaacacttggtcttcctggtgtcttaattccctcagacaagtttatgcacttttttaaggaaatatttttcaggacactagtaagaagctcagttcacagtttggatatttcttcccacattacagaattatggaaaggaactcaaaatcagcctaggaaagtgagtcctgcttgacccatgtgactgtgtacctgaccttctgggatcttttcagctattaaaacattttactgttcccacatacccagctttgcaagttttgtagattgacctcttagggtgtgtttctttgtctttcctgcctttaacttgctggggtcttttgttgctacccctaaggaactaaactgggtgccaggagctaccttcgtgtatagagatgtagatggcagtgtggggtacaggagagccatccaggccattctcccagggatgaggaattggagagccctgaagataatagtggcttctttctgattgctactgtgctgtgtgataggcctaatagggaaaagatatgtaacttgaaacaaagttggtataaattcagtatgtggctgtgggacagaggttggaaggaaaggactagggtatggaaagctgaagaaattctccttatgagctctcgttgactttttgaacagtgataagctaatgccagatttaaaatacacattttttcctatttgagtctttaggattatatcatttgaaaaaattgccttccttgttaggtcacatgtcataggagagtagcttagagaacttgcattaccagacagacacattaattcccaaagcctctatgttgagagaatgaaactgttaactctttttcagagaggactatgaataaagaaacttctttattcaagcttcagctttcagctgggttgtttcctctaaaagggaaagggcattgcaagtgcatagaggaaatctctcccttctgggactgcttttcctccttcatcctcgtgagcctgtccaagctcagaattccgaaggctgttagaaatgcgttgggattgcagagagaaaggagcttgtctttccttctgctgtgctggtctgttttggatgtcagtcttcaggactatgaaaacttcctgccagtttagcatggacactgagggctggcatttctagtcttcttcagacactgaacatactgactccaggtataggaagcagctagcaaattgattcttttttaaatgcataggactctgcttccggcggttcctcttgtagtccaactctttttgccatctatttatgttgggaggtaggggcacaattgtcactcacaacacaggctagttagagtttgctaccttcttagcagaaaatgcatgtgtgtcttgttggaccttcactggggaaaggctgggagcctctggctgtcagtgacttttctcacagaagaagaaccagcaagccagactggacacctttaccctttaatggtaagacttgtatttataaggggtaattttgatgttgaatttaagccactactttgtttaaacttttttaaattggcaactagaagtttgagaatttgtatagaaatggaacatgtatttctaacagttgccaatctggctggtcccaatgttagtttattagtgattgatctgtaattattgggattatttattcaactctaaaattccaagatgaaaataatttatctctttcttttcaagggaaaaaacccaaatgaatgcattttcagtttctccaggcctttgaactgcagcagaaaattcaaggatacagcctaggcctgggcaaatgcagccctgggtctttgggccagtttctgacaataatagttgagttttgggaatcacataagggtgaaaccagaaacgatcctaaggaaaggcttgacctttgttaacacctttagtttccaaagtcacagcagctggggtccctcttttttttttttttttctttttttttgagacatagtctcactctgtcacccaggctggagtgcagtggtatgaccatagctcactgcagcatcaaattcctaggctcaagcaatcctcccatcttagcctcccgagtagctgggacaacaggtacgcaccaccacggccagctaattatttttattatttttattttttgtagagactggatcttgctctatttcccaagctactcttgaattgttgtgctcaagtgattctcccatctcagcctcccaaagtgctgggattataggctgggtgtggtgagccaccccagcctggggtctctttaattaaggttataatgctaaccatggcttaaaatactaagcaacattttccaaattgtttattactattgctttgattttggagaagctgggaagtaaggaggtgaggtgaatactctgataattaacacgtgttagagaggaaagttgtgtgaagaggctgccaaagtaaacagcacgaatgaatcttcttgtactagggctgctgcaaaccccaggtagacaaatgacagcccaggctcctgaaccatcaggaacccaggaatctacccaactgtgaggagggggcaggccttcgtcaataagggtcccaccatcacgggctaataatctttctcagtttaggtgatattgaggtattgaaactgttagaaatctgacagatttgaccaagatttggagacgtccacataattgggaaggactgagtgtccctagccactctcctctgggataacgcggacgtcattagtttgcgaagtgggtggggagaacaggaggattgactctaatttggtgtgtagtgggggccttgatgtccttctgcctctgtccacatttccccatgtgactcattgcaccctgcattgctcacagggatcattagttctcccggtagacagagcacctctgcagcctctgctctgctgccttgtgaatttcctacacagacttggttagttacaatttggaaacagtttttttgggtttttttcctttgttttaatcttctcacaatgaagctgctattggtgacagggacaggggagcaggaagccaacccagggaaacatgcgagtttcctgcacaccacttagtcacctgccctcactggccaaccccctactgctgttcccagtcagtctggtttttagaggcatcgtggcaatagaatagctggatacactaatctctacaaggtgtcaggcaggagattcaccttccccagtcccaggggacaggagagaaatctgtaaagggacagatgcaccatctttatttcaaaagaaaaagctccctcagattgtgttactaggagtctcttttgtgacatttactgacctttctccccaatcttaccttcctattggctactttttaaataaaaataaacattttaggctaatatgacaaaaatgagataaaatcttaaaaacattgtactagtgtacagttactaaaatgtgcttactacaaaacagtaaaatatttcactctgtaaatcatcactaagtagttattctgtcctgttgattatgagcctccaaaaatgtttaatgcttgaaggatggtttgggaggcagggaatccttttcttaaaacaactttaatgaggcatatgttacatatcataaaacacccatttcaagtgtacatttcagtgattttagtaacttccctcagtggtgtagctgtaactattactcagttttagaacatttttatccctcccaataagatccttcatgctcttttacagttaatcctgttcttacccccggcaaccactaatctactttctctataaatttgccctttctggacagttcaaatcaatggaatcatacaatatgtggtcccttgggtctggcttttttacttagctaatgtttttgaggtttgtccatgacagataacgtcttggtagtttgttccttttattgctgagtagaattctgttgatggatgtaccacattttgtcagcagagagccttttaaacttggattccaacttcctgttgtctaaacggaaccctccgaacgtaggacttataggggaagctgctgtgcatgtcaaaaaaactactaatcagaatgagctttgtcatccagagccagaactgctgcagaaatttttataattttgcaacttctttttttacaaggaacttttgtgctactacacatcaggacttttgaagcatccaataaatccatttaataagtatgagcatgtgtctgagtggacaagaaagtgaaaccatccatgctacattggataatttttcctcccccagactggatagggaatctcaactttcaaaatagagtatcctggctccatttacaaagctgcacaggtattaaagatcgtgctgcctttgttaggcagatttggaggggaggcccaacagcaaagatggagaggaaaaagggagtggagcttgtggaacaggaaggcagcccagcacctccactgggcccagaaggtcttgacttcggacacttacccctgtttcacaagtgtttataaagctgtttttgcttttgtttttctcctaaataatccttacttggtagttattaatccttctttgggggagggacagggctttaaaactgaagaaaataattttcataaaaatatcaaaaatggaaaaaagttactttgtaaaaaatttgctatacaaaccaaatggcagctgttgagaatctcaataaaatgttaaatgca

SEQ ID NO: 67971 - DNA, 6287 bp, Homo sapiens
  misc_feature (162)..(162): n is a, c, g, or t
ctggcaagtggtagtggcgcttctcgggtgctgtgcttcacgttttggtactaaaggccgagactgttgtggcgacggcgacctctacggcaacggcttaagctctcggaggagtggcagagtacgatctgaaggaggggcttctggttagcccaggttccntcataatgaatggatccaatatggcaaatacatcaccgagtgtaaaatccaaagaggaccaggggttaagtgggcacgatgaaaaggaaaacccatttgcagagtacatgtggatggagaatgaagaggatttcaacagacaggtggaggaggaactgcaggagcaagacttcttggaccgctgcttccaagagatgctggatgaagaagaccaagactggtttattccatcacgagacctgcctcaggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcacaaaatggtggagctgaagagggggatggggcgggcgaggggtgcacagcgggaaggggagtggtggtctcacgatactgtgactctgagtaactaatatgctcagtcttattctaagcctctgagtatttctattttgttctgctgacttttgtttggggagtttcctgttttgtttttttaaatagctctttcgagttaaggaaattgcattttccccccttcatcagaagtgttccgcggtgtgtatttaaacaaaataagctgactaagaaaaactggatatttaggaaatgcccctctcaccctgctgtatacttatcagggacagtgagcacctggagagctttttgtggaatctattgagttggatgggaaaagggacaagcagaaagagcaggtggtgcaaactggaatttgaggctcagctgccccacccccggggtctcctgcaatgaactcggataaccaatgtgctgtcaagcccttgcctgtttgtcctgaaccccattcaagaaaacacagacttaaagtacttagtttacagtaacttttgatgattgttgaaagttgtaaatcagaaggtagggctgtgatggtggttgtcacttgagtcatttagttactgttgtcctgttcataagcctgtgttcaccaccaccatcagactcaccatttataagtagaagagcactagggttgatctgccacctcatctttcatgaagtctattccccagcctcctttttaagaaaagatactgctaccaaaggcataggggaggcctgctgtgctggcaattagcatgagcctgcagaagtcatccttgaatctgttgtgtcttaattttatttggacagtttttttttccagcctcatcaacacttggtcttcctggtgtcttaattccctcagacaagtttatgcacttttttaaggaaatatttttcaggacactagtaagaagctcagttcacagtttggatatttcttcccacattacagaattatggaaaggaactcaaaatcagcctaggaaagtgagtcctgcttgacccatgtgactgtgtacctgaccttctgggatcttttcagctattaaaacattttactgttcccacatacccagctttgcaagttttgtagattgacctcttagggtgtgtttctttgtctttcctgcctttaacttgctggggtcttttgttgctacccctaaggaactaaactgggtgccaggagctaccttcgtgtatagagatgtagatggcagtgtggggtacaggagagccatccaggccattctcccagggatgaggaattggagagccctgaagataatagtggcttctttctgattgctactgtgctgtgtgataggcctaatagggaaaagatatgtaacttgaaacaaagttggtataaattcagtatgtggctgtgggacagaggttggaaggaaaggactagggtatggaaagctgaagaaattctccttatgagctctcgttgactttttgaacagtgataagctaatgccagatttaaaatacacattttttcctatttgagtctttaggattatatcatttgaaaaaattgccttccttgttaggtcacatgtcataggagagtagcttagagaacttgcattaccagacagacacattaattcccaaagcctctatgttgagagaatgaaactgttaactctttttcagagaggactatgaataaagaaacttctttattcaagcttcagctttcagctgggttgtttcctctaaaagggaaagggcattgcaagtgcatagaggaaatctctcccttctgggactgcttttcctccttcatcctcgtgagcctgtccaagctcagaattccgaaggctgttagaaatgcgttgggattgcagagagaaaggagcttgtctttccttctgctgtgctggtctgttttggatgtcagtcttcaggactatgaaaacttcctgccagtttagcatggacactgagggctggcatttctagtcttcttcagacactgaacatactgactccaggtataggaagcagctagcaaattgattcttttttaaatgcataggactctgcttccggcggttcctcttgtagtccaactctttttgccatctatttatgttgggaggtaggggcacaattgtcactcacaacacaggctagttagagtttgctaccttcttagcagaaaatgcatgtgtgtcttgttggaccttcactggggaaaggctgggagcctctggctgtcagtgacttttctcacagaagaagaaccagcaagccagactggacacctttaccctttaatggtaagacttgtatttataaggggtaattttgatgttgaatttaagccactactttgtttaaacttttttaaattggcaactagaagtttgagaatttgtatagaaatggaacatgtatttctaacagttgccaatctggctggtcccaatgttagtttattagtgattgatctgtaattattgggattatttattcaactctaaaattccaagatgaaaataatttatctctttcttttcaagggaaaaaacccaaatgaatgcattttcagtttctccaggcctttgaactgcagcagaaaattcaaggatacagcctaggcctgggcaaatgcagccctgggtctttgggccagtttctgacaataatagttgagttttgggaatcacataagggtgaaaccagaaacgatcctaaggaaaggcttgacctttgttaacacctttagtttccaaagtcacagcagctggggtccctcttttttttttttttttctttttttttgagacatagtctcactctgtcacccaggctggagtgcagtggtatgaccatagctcactgcagcatcaaattcctaggctcaagcaatcctcccatcttagcctcccgagtagctgggacaacaggtacgcaccaccacggccagctaattatttttattatttttattttttgtagagactggatcttgctctatttcccaagctactcttgaattgttgtgctcaagtgattctcccatctcagcctcccaaagtgctgggattataggctgggtgtggtgagccaccccagcctggggtctctttaattaaggttataatgctaaccatggcttaaaatactaagcaacattttccaaattgtttattactattgctttgattttggagaagctgggaagtaaggaggtgaggtgaatactctgataattaacacgtgttagagaggaaagttgtgtgaagaggctgccaaagtaaacagcacgaatgaatcttcttgtactagggctgctgcaaaccccaggtagacaaatgacagcccaggctcctgaaccatcaggaacccaggaatctacccaactgtgaggagggggcaggccttcgtcaataagggtcccaccatcacgggctaataatctttctcagtttaggtgatattgaggtattgaaactgttagaaatctgacagatttgaccaagatttggagacgtccacataattgggaaggactgagtgtccctagccactctcctctgggataacgcggacgtcattagtttgcgaagtgggtggggagaacaggaggattgactctaatttggtgtgtagtgggggccttgatgtccttctgcctctgtccacatttccccatgtgactcattgcaccctgcattgctcacagggatcattagttctcccggtagacagagcacctctgcagcctctgctctgctgccttgtgaatttcctacacagacttggttagttacaatttggaaacagtttttttgggtttttttcctttgttttaatcttctcacaatgaagctgctattggtgacagggacaggggagcaggaagccaacccagggaaacatgcgagtttcctgcacaccacttagtcacctgccctcactggccaaccccctactgctgttcccagtcagtctggtttttagaggcatcgtggcaatagaatagctggatacactaatctctacaaggtgtcaggcaggagattcaccttccccagtcccaggggacaggagagaaatctgtaaagggacagatgcaccatctttatttcaaaagaaaaagctccctcagattgtgttactaggagtctcttttgtgacatttactgacctttctccccaatcttaccttcctattggctactttttaaataaaaataaacattttaggctaatatgacaaaaatgagataaaatcttaaaaacattgtactagtgtacagttactaaaatgtgcttactacaaaacagtaaaatatttcactctgtaaatcatcactaagtagttattctgtcctgttgattatgagcctccaaaaatgtttaatgcttgaaggatggtttgggaggcagggaatccttttcttaaaacaactttaatgaggcatatgttacatatcataaaacacccatttcaagtgtacatttcagtgattttagtaacttccctcagtggtgtagctgtaactattactcagttttagaacatttttatccctcccaataagatccttcatgctcttttacagttaatcctgttcttacccccggcaaccactaatctactttctctataaatttgccctttctggacagttcaaatcaatggaatcatacaatatgtggtcccttgggtctggcttttttacttagctaatgtttttgaggtttgtccatgacagataacgtcttggtagtttgttccttttattgctgagtagaattctgttgatggatgtaccacattttgtcagcagagagccttttaaacttggattccaacttcctgttgtctaaacggaaccctccgaacgtaggacttataggggaagctgctgtgcatgtcaaaaaaactactaatcagaatgagctttgtcatccagagccagaactgctgcagaaatttttataattttgcaacttctttttttacaaggaacttttgtgctactacacatcaggacttttgaagcatccaataaatccatttaataagtatgagcatgtgtctgagtggacaagaaagtgaaaccatccatgctacattggataatttttcctcccccagactggatagggaatctcaactttcaaaatagagtatcctggctccatttacaaagctgcacaggtattaaagatcgtgctgcctttgttaggcagatttggaggggaggcccaacagcaaagatggagaggaaaaagggagtggagcttgtggaacaggaagccccccagggtctgtgcagggctgctcagctcttgaggatgttgtggatggtgaagtggtgatggtgtcctggagcagcccagcacctccactgggcccagaaggtcttgacttcggacacttacccctgtttcacaagtgtttataaagctgtttttgcttttgtttttctcctaaataatccttacttggtagttattaatccttctttgggggagggacagggctttaaaactgaagaaaataattttcataaaaatatcaaaaatggaaaaaagttactttgtaaaaaatttgctatacaaaccaaatggcagctgttgagaatctcaataaaatgttaaatgca

SEQ ID NO: 67972 - DNA, 6034 bp, Homo sapiens
ttgtttgaaatggagtgtcgctctgtcgcccatgctggagtgcagtggcaccgtggaggaggaactgcaggagcaagacttcttggaccgctgcttccaagagatgctggatgaagaagaccaagactggtttattccatcacgagacctgcctcaggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcacaaaatggtggagctgaagagggggatggggcgggcgaggggtgcacagcgggaaggggagtggtggtctcacgatactgtgactctgagtaactaatatgctcagtcttattctaagcctctgagtatttctattttgttctgctgacttttgtttggggagtttcctgttttgtttttttaaatagctctttcgagttaaggaaattgcattttccccccttcatcagaagtgttccgcggtgtgtatttaaacaaaataagctgactaagaaaaactggatatttaggaaatgcccctctcaccctgctgtatacttatcagggacagtgagcacctggagagctttttgtggaatctattgagttggatgggaaaagggacaagcagaaagagcaggtggtgcaaactggaatttgaggctcagctgccccacccccggggtctcctgcaatgaactcggataaccaatgtgctgtcaagcccttgcctgtttgtcctgaaccccattcaagaaaacacagacttaaagtacttagtttacagtaacttttgatgattgttgaaagttgtaaatcagaaggtagggctgtgatggtggttgtcacttgagtcatttagttactgttgtcctgttcataagcctgtgttcaccaccaccatcagactcaccatttataagtagaagagcactagggttgatctgccacctcatctttcatgaagtctattccccagcctcctttttaagaaaagatactgctaccaaaggcataggggaggcctgctgtgctggcaattagcatgagcctgcagaagtcatccttgaatctgttgtgtcttaattttatttggacagtttttttttccagcctcatcaacacttggtcttcctggtgtcttaattccctcagacaagtttatgcacttttttaaggaaatatttttcaggacactagtaagaagctcagttcacagtttggatatttcttcccacattacagaattatggaaaggaactcaaaatcagcctaggaaagtgagtcctgcttgacccatgtgactgtgtacctgaccttctgggatcttttcagctattaaaacattttactgttcccacatacccagctttgcaagttttgtagattgacctcttagggtgtgtttctttgtctttcctgcctttaacttgctggggtcttttgttgctacccctaaggaactaaactgggtgccaggagctaccttcgtgtatagagatgtagatggcagtgtggggtacaggagagccatccaggccattctcccagggatgaggaattggagagccctgaagataatagtggcttctttctgattgctactgtgctgtgtgataggcctaatagggaaaagatatgtaacttgaaacaaagttggtataaattcagtatgtggctgtgggacagaggttggaaggaaaggactagggtatggaaagctgaagaaattctccttatgagctctcgttgactttttgaacagtgataagctaatgccagatttaaaatacacattttttcctatttgagtctttaggattatatcatttgaaaaaattgccttccttgttaggtcacatgtcataggagagtagcttagagaacttgcattaccagacagacacattaattcccaaagcctctatgttgagagaatgaaactgttaactctttttcagagaggactatgaataaagaaacttctttattcaagcttcagctttcagctgggttgtttcctctaaaagggaaagggcattgcaagtgcatagaggaaatctctcccttctgggactgcttttcctccttcatcctcgtgagcctgtccaagctcagaattccgaaggctgttagaaatgcgttgggattgcagagagaaaggagcttgtctttccttctgctgtgctggtctgttttggatgtcagtcttcaggactatgaaaacttcctgccagtttagcatggacactgagggctggcatttctagtcttcttcagacactgaacatactgactccaggtataggaagcagctagcaaattgattcttttttaaatgcataggactctgcttccggcggttcctcttgtagtccaactctttttgccatctatttatgttgggaggtaggggcacaattgtcactcacaacacaggctagttagagtttgctaccttcttagcagaaaatgcatgtgtgtcttgttggaccttcactggggaaaggctgggagcctctggctgtcagtgacttttctcacagaagaagaaccagcaagccagactggacacctttaccctttaatggtaagacttgtatttataaggggtaattttgatgttgaatttaagccactactttgtttaaacttttttaaattggcaactagaagtttgagaatttgtatagaaatggaacatgtatttctaacagttgccaatctggctggtcccaatgttagtttattagtgattgatctgtaattattgggattatttattcaactctaaaattccaagatgaaaataatttatctctttcttttcaagggaaaaaacccaaatgaatgcattttcagtttctccaggcctttgaactgcagcagaaaattcaaggatacagcctaggcctgggcaaatgcagccctgggtctttgggccagtttctgacaataatagttgagttttgggaatcacataagggtgaaaccagaaacgatcctaaggaaaggcttgacctttgttaacacctttagtttccaaagtcacagcagctggggtccctcttttttttttttttttctttttttttgagacatagtctcactctgtcacccaggctggagtgcagtggtatgaccatagctcactgcagcatcaaattcctaggctcaagcaatcctcccatcttagcctcccgagtagctgggacaacaggtacgcaccaccacggccagctaattatttttattatttttattttttgtagagactggatcttgctctatttcccaagctactcttgaattgttgtgctcaagtgattctcccatctcagcctcccaaagtgctgggattataggctgggtgtggtgagccaccccagcctggggtctctttaattaaggttataatgctaaccatggcttaaaatactaagcaacattttccaaattgtttattactattgctttgattttggagaagctgggaagtaaggaggtgaggtgaatactctgataattaacacgtgttagagaggaaagttgtgtgaagaggctgccaaagtaaacagcacgaatgaatcttcttgtactagggctgctgcaaaccccaggtagacaaatgacagcccaggctcctgaaccatcaggaacccaggaatctacccaactgtgaggagggggcaggccttcgtcaataagggtcccaccatcacgggctaataatctttctcagtttaggtgatattgaggtattgaaactgttagaaatctgacagatttgaccaagatttggagacgtccacataattgggaaggactgagtgtccctagccactctcctctgggataacgcggacgtcattagtttgcgaagtgggtggggagaacaggaggattgactctaatttggtgtgtagtgggggccttgatgtccttctgcctctgtccacatttccccatgtgactcattgcaccctgcattgctcacagggatcattagttctcccggtagacagagcacctctgcagcctctgctctgctgccttgtgaatttcctacacagacttggttagttacaatttggaaacagtttttttgggtttttttcctttgttttaatcttctcacaatgaagctgctattggtgacagggacaggggagcaggaagccaacccagggaaacatgcgagtttcctgcacaccacttagtcacctgccctcactggccaaccccctactgctgttcccagtcagtctggtttttagaggcatcgtggcaatagaatagctggatacactaatctctacaaggtgtcaggcaggagattcaccttccccagtcccaggggacaggagagaaatctgtaaagggacagatgcaccatctttatttcaaaagaaaaagctccctcagattgtgttactaggagtctcttttgtgacatttactgacctttctccccaatcttaccttcctattggctactttttaaataaaaataaacattttaggctaatatgacaaaaatgagataaaatcttaaaaacattgtactagtgtacagttactaaaatgtgcttactacaaaacagtaaaatatttcactctgtaaatcatcactaagtagttattctgtcctgttgattatgagcctccaaaaatgtttaatgcttgaaggatggtttgggaggcagggaatccttttcttaaaacaactttaatgaggcatatgttacatatcataaaacacccatttcaagtgtacatttcagtgattttagtaacttccctcagtggtgtagctgtaactattactcagttttagaacatttttatccctcccaataagatccttcatgctcttttacagttaatcctgttcttacccccggcaaccactaatctactttctctataaatttgccctttctggacagttcaaatcaatggaatcatacaatatgtggtcccttgggtctggcttttttacttagctaatgtttttgaggtttgtccatgacagataacgtcttggtagtttgttccttttattgctgagtagaattctgttgatggatgtaccacattttgtcagcagagagccttttaaacttggattccaacttcctgttgtctaaacggaaccctccgaacgtaggacttataggggaagctgctgtgcatgtcaaaaaaactactaatcagaatgagctttgtcatccagagccagaactgctgcagaaatttttataattttgcaacttctttttttacaaggaacttttgtgctactacacatcaggacttttgaagcatccaataaatccatttaataagtatgagcatgtgtctgagtggacaagaaagtgaaaccatccatgctacattggataatttttcctcccccagactggatagggaatctcaactttcaaaatagagtatcctggctccatttacaaagctgcacaggtattaaagatcgtgctgcctttgttaggcagatttggaggggaggcccaacagcaaagatggagaggaaaaagggagtggagcttgtggaacaggaagccccccagggtctgtgcagggctgctcagctcttgaggatgttgtggatggtgaagtggtgatggtgtcctggagcagcccagcacctccactgggcccagaaggtcttgacttcggacacttacccctgtttcacaagtgtttataaagctgtttttgcttttgtttttctcctaaataatccttacttggtagttattaatccttctttgggggagggacagggctttaaaactgaagaaaataattttcataaaaatatcaaaaatggaaaaaagttactttgtaaaaaatttgctatacaaaccaaatggcagctgttgagaatctcaataaaatgttaaatgca

SEQ ID NO: 67973 - DNA, 6253 bp, Homo sapiens
  misc_feature (162)..(162): n is a, c, g, or t
ctggcaagtggtagtggcgcttctcgggtgctgtgcttcacgttttggtactaaaggccgagactgttgtggcgacggcgacctctacggcaacggcttaagctctcggaggagtggcagagtacgatctgaaggaggggcttctggttagcccaggttccntcataatgaatggatccaatatggcaaatacatcaccgagtgtaaaatccaaagaggaccaggggttaagtgggcacgatgaaaaggaaaacccatttgcagagtacatgtggatggagaatgaagaggatttcaacagacaggtggaggaggaactgcaggagcaagacttcttggaccgctgcttccaagagatgctggatgaagaagaccaagactggtttattccatcacgagacctgcctcaggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcacaaaatggtggagctgaagagggggatggggcgggcgaggggtgcacagcgggaaggggagtggtggtctcacgatactgtgactctgagtaactaatatgctcagtcttattctaagcctctgagtatttctattttgttctgctgacttttgtttggggagtttcctgttttgtttttttaaatagctctttcgagttaaggaaattgcattttccccccttcatcagaagtgttccgcggtgtgtatttaaacaaaataagctgactaagaaaaactggatatttaggaaatgcccctctcaccctgctgtatacttatcagggacagtgagcacctggagagctttttgtggaatctattgagttggatgggaaaagggacaagcagaaagagcaggtggtgcaaactggaatttgaggctcagctgccccacccccggggtctcctgcaatgaactcggataaccaatgtgctgtcaagcccttgcctgtttgtcctgaaccccattcaagaaaacacagacttaaagtacttagtttacagtaacttttgatgattgttgaaagttgtaaatcagaaggtagggctgtgatggtggttgtcacttgagtcatttagttactgttgtcctgttcataagcctgtgttcaccaccaccatcagactcaccatttataagtagaagagcactagggttgatctgccacctcatctttcatgaagtctattccccagcctcctttttaagaaaagatactgctaccaaaggcataggggaggcctgctgtgctggcaattagcatgagcctgcagaagtcatccttgaatctgttgtgtcttaattttatttggacagtttttttttccagcctcatcaacacttggtcttcctggtgtcttaattccctcagacaagtttatgcacttttttaaggaaatatttttcaggacactagtaagaagctcagttcacagtttggatatttcttcccacattacagaattatggaaaggaactcaaaatcagcctaggaaagtgagtcctgcttgacccatgtgactgtgtacctgaccttctgggatcttttcagctattaaaacattttactgttcccacatacccagctttgcaagttttgtagattgacctcttagggtgtgtttctttgtctttcctgcctttaacttgctggggtcttttgttgctacccctaaggaactaaactgggtgccaggagctaccttcgtgtatagagatgtagatggcagtgtggggtacaggagagccatccaggccattctcccagggatgaggaattggagagccctgaagataatagtggcttctttctgattgctactgtgctgtgtgataggcctaatagggaaaagatatgtaacttgaaacaaagttggtataaattcagtatgtggctgtgggacagaggttggaaggaaaggactagggtatggaaagctgaagaaattctccttatgagctctcgttgactttttgaacagtgataagctaatgccagatttaaaatacacattttttcctatttgagtctttaggattatatcatttgaaaaaattgccttccttgttaggtcacatgtcataggagagtagcttagagaacttgcattaccagacagacacattaattcccaaagcctctatgttgagagaatgaaactgttaactctttttcagagaggactatgaataaagaaacttctttattcaagcttcagctttcagctgggttgtttcctctaaaagggaaagggcattgcaagtgcatagaggaaatctctcccttctgggactgcttttcctccttcatcctcgtgagcctgtccaagctcagaattccgaaggctgttagaaatgcgttgggattgcagagagaaaggagcttgtctttccttctgctgtgctggtctgttttggatgtcagtcttcaggactatgaaaacttcctgccagtttagcatggacactgagggctggcatttctagtcttcttcagacactgaacatactgactccaggtataggaagcagctagcaaattgattcttttttaaatgcataggactctgcttccggcggttcctcttgtagtccaactctttttgccatctatttatgttgggaggtaggggcacaattgtcactcacaacacaggctagttagagtttgctaccttcttagcagaaaatgcatgtgtgtcttgttggaccttcactggggaaaggctgggagcctctggctgtcagtgacttttctcacagaagaagaaccagcaagccagactggacacctttaccctttaatggtaagacttgtatttataaggggtaattttgatgttgaatttaagccactactttgtttaaacttttttaaattggcaactagaagtttgagaatttgtatagaaatggaacatgtatttctaacagttgccaatctggctggtcccaatgttagtttattagtgattgatctgtaattattgggattatttattcaactctaaaattccaagatgaaaataatttatctctttcttttcaagggaaaaaacccaaatgaatgcattttcagtttctccaggcctttgaactgcagcagaaaattcaaggatacagcctaggcctgggcaaatgcagccctgggtctttgggccagtttctgacaataatagttgagttttgggaatcacataagggtgaaaccagaaacgatcctaaggaaaggcttgacctttgttaacacctttagtttccaaagtcacagcagctggggtccctcttttttttttttttttctttttttttgagacatagtctcactctgtcacccaggctggagtgcagtggtatgaccatagctcactgcagcatcaaattcctaggctcaagcaatcctcccatcttagcctcccgagtagctgggacaacaggtacgcaccaccacggccagctaattatttttattatttttattttttgtagagactggatcttgctctatttcccaagctactcttgaattgttgtgctcaagtgattctcccatctcagcctcccaaagtgctgggattataggctgggtgtggtgagccaccccagcctggggtctctttaattaaggttataatgctaaccatggcttaaaatactaagcaacattttccaaattgtttattactattgctttgattttggagaagctgggaagtaaggaggtgaggtgaatactctgataattaacacgtgttagagaggaaagttgtgtgaagaggctgccaaagtaaacagcacgaatgaatcttcttgtactagggctgctgcaaaccccaggtagacaaatgacagcccaggctcctgaaccatcaggaacccaggaatctacccaactgtgaggagggggcaggccttcgtcaataagggtcccaccatcacgggctaataatctttctcagtttaggtgatattgaggtattgaaactgttagaaatctgacagatttgaccaagatttggagacgtccacataattgggaaggactgagtgtccctagccactctcctctgggataacgcggacgtcattagtttgcgaagtgggtggggagaacaggaggattgactctaatttggtgtgtagtgggggccttgatgtccttctgcctctgtccacatttccccatgtgactcattgcaccctgcattgctcacagggatcattagttctcccggtagacagagcacctctgcagcctctgctctgctgccttgtgaatttcctacacagacttggttagttacaatttggaaacagtttttttgggtttttttcctttgttttaatcttctcacaatgaagctgctattggtgacagggacaggggagcaggaagccaacccagggaaacatgcgagtttcctgcacaccacttagtcacctgccctcactggccaaccccctactgctgttcccagtcagtctggtttttagaggcatcgtggcaatagaatagctggatacactaatctctacaaggtgtcaggcaggagattcaccttccccagtcccaggggacaggagagaaatctgtaaagggacagatgcaccatctttatttcaaaagaaaaagctccctcagattgtgttactaggagtctcttttgtgacatttactgacctttctccccaatcttaccttcctattggctactttttaaataaaaataaacattttaggctaatatgacaaaaatgagataaaatcttaaaaacattgtactagtgtacagttactaaaatgtgcttactacaaaacagtaaaatatttcactctgtaaatcatcactaagtagttattctgtcctgttgattatgagcctccaaaaatgtttaatgcttgaaggatggtttgggaggcagggaatccttttcttaaaacaactttaatgaggcatatgttacatatcataaaacacccatttcaagtgtacatttcagtgattttagtaacttccctcagtggtgtagctgtaactattactcagttttagaacatttttatccctcccaataagatccttcatgctcttttacagttaatcctgttcttacccccggcaaccactaatctactttctctataaatttgccctttctggacagttcaaatcaatggaatcatacaatatgtggtcccttgggtctggcttttttacttagctaatgtttttgaggtttgtccatgacagataacgtcttggtagtttgttccttttattgctgagtagaattctgttgatggatgtaccacattttgtcagcagagagccttttaaacttggattccaacttcctgttgtctaaacggaaccctccgaacgtaggacttataggggaagctgctgtgcatgtcaaaaaaactactaatcagaatgagctttgtcatccagagccagaactgctgcagaaatttttataattttgcaacttctttttttacaaggaacttttgtgctactacacatcaggacttttgaagcatccaataaatccatttaataagtatgagcatgtgtctgagtggacaagaaagtgaaaccatccatgctacattggataatttttcctcccccagactggatagggaatctcaactttcaaaatagagtatcctggctccatttacaaagctgcacaggtattaaagatcgtgctgcctttgttaggcagatttggaggggaggcccaacagcaaagatggagaggaaaaagggagtggagcttgtggaacaggaagccccccagggtctgtgcagggctgctcagctcttgaggatgcagcccagcacctccactgggcccagaaggtcttgacttcggacacttacccctgtttcacaagtgtttataaagctgtttttgcttttgtttttctcctaaataatccttacttggtagttattaatccttctttgggggagggacagggctttaaaactgaagaaaataattttcataaaaatatcaaaaatggaaaaaagttactttgtaaaaaatttgctatacaaaccaaatggcagctgttgagaatctcaataaaatgttaaatgca

SEQ ID NO: 67974 - DNA, 2204 bp, Homo sapiens
  misc_feature (90)..(90): n is a, c, g, or t
atttgaaaggtcaaatatcatcagtggcaataaatactgtgtcagttatcttccttcaagtgacaggctcatttaagatatttttgaganaatgtctgccagatacccagtgcttgagtggcagttgcttattctttcaagtaataacagtggtttgtgaaaatgttcatgattcaaagaatttcatcctaagcactttttcttgacacagtcattgcacttggttgtgcagcacagagctccgtatgcacttcccgtctcgtcactgctcgttacgttaataagacctctgtcaagggttgatatttaatcaagttaacactttttactgcttcatcgagggcattcttaagttaaactgactttttaaaacacagagtgaggaatcactaattccacagtacagcactactgctgccttgattagttccaagagccggtagttttaccaccatagcttttctatcatcagtgcaaaagtttcactatagcttttttatgatcggtgcaaaagtcagcactgtaaaaagaaatagttttattatgaaaatcgttttggtttcatgggccatattttgagaaccactgatgtctaagcctcagtttcctcatctgcagaatggagataatagtgtcccatttcaaagggatgaagatttcatgatttaatgcatgtaaagcacttagcattgtaccttacatagaacaagcattcagtaaatgttaactacccctattaatttcttgaaggaaggctgaacaataaaaacattttaaaggaaaaaaaggaaatctaacttagtcctactagcaaaacacaactgagttaactgttgggatttttgtccattcctcacacttttttcagtataatcctttcttttccctttttgtatagatacagattatcttatgtcaacatttgctgatgagaattccagggagcatgagtttcttgggttctactagttccacagaagcagtagtatagcctgatggtgaagaggcagattctagaggcagactatcatgggtcaaaccccagctctgccacttcctagccatatgaccttgggaaaggcatttaacttttttctgctgtactacctaccccattaggcttgttgtgaggattaaataagttagttgatgtaaagcatagaatagtgccaggcgtttagtatgcagtcagtatgtgttgcttattattaaatgaggaaagggctctctggttaaataaagttgggaaaacctgaactaaaaaaaaattaagcaagatttctttctttactgtaggattatttagtctttaatatgaggtatgaatttttaagagggatcttaaatcacatgaaaccgacttaaccatgggaatctttttgacatgggtatcttacagagctaatgagccttttctttttgagcatactaaatatccttaggctcttatattactttgttttcatcaggggtgagttcatttggggtggttgattttattaactgtctgttttagcattaggtttagaactcaggatgtttttaagaggacacacttcaaagtagaatattagttacaacatctgttctcttgtttaatattatgcagtctcagattggcctacatttgacaactactttacatctttgtggaaagattgctcaagtggtaattacagggtagatttcaatgcattgcacctatcctttaatctcacattcattctaataaaatatttgtagaatgaatattttgttattctgtggtctacatatgcctatgaaagtacgtaagcctctctaaaaacgaacaattctactgggctattattctgacagcaactctggctaatgcagttcccatttagtgagattttagcagtgccatgtctttgaagtataattttgaagcactctccgataactataatgctagaatcatttgatgatatatgtggcccaatttggtgtgaaacagaatgaaccttctaaaagaattactgctttcaattcacacctagttttaaattgcattcaagtaaaaaaactagcattttttttcttgtctttcaaggagaagtatgttttctctccacagattccttacttatatagtagtaatacagagaaattctaaaaatatttgaaataaaaatatagccctggtagggaatatttggatttttagaacccaagctttaatg

SEQ ID NO: 67975 - DNA, 359 bp, Homo sapiens
atagtgtaaattgctagaaccatttagaaaaagtacttgtcattgtctataaacaatcattcatactgctaagatcatttgaggatttttataataaaattataaacatgcacacacacacacacacacacgcacgcacacaaatatatacatacatactcatccatactctcattcagcaattatatggggaagattgacattgatattttctgaattagaggttagaggttagttttcatatacactgattaattacatattttttacataaaagttatcaaatgtaaaacaatgttctttttttttttactgggcagcatggcatacattgttcttatactcaccaactatatctt

SEQ ID NO: 67976 - DNA, 761 bp, Homo sapiens
cagcagatgcaggccgttcttccataacagaatagaccagtcttctcttgcttgtaataaggtcacctaagccaatggtttgtgaggagggttttacttttctcaagatctacacccatccctcctgacatctaaaggttgaaatagagtcggatctcagcatactcaagggggataaggcacagaggctggcatagaagaaggctcatactcctaaagacatgcaagatttttatatttgtattggcagaaaactgagtgatatacatgggaattctaaggattttaaactaagaggaatatatcattgaattgggttgaatttattgacatcggtgcatgaacctgagattctgggtgtgatatgttggcttgtgtgctaataataatatgtagtctcccaggagcctttaaagggacacatccctgctgacaccttgattttaacccagtgagacccattttggatttttgttttccagaactgtaagagaaatttctgttgttgttagccactatatttggattagtttgttaaagtggcaataggagaccagtacactcttttagcctagacagcctctctccctcttcctacaacacaaccaaactcaaactgaagtcaccagatcacctgcccttagagcttgggccatgcaacatcctccagaatggagttaggcagttctgcaaggcttagctgtggaatgaagtgagaccgccccatctcattagcacaggagaaactggaaactagaaaa

SEQ ID NO: 67977 - DNA, 491 bp, Homo sapiens
ccatggagcccactgccttgggtttttcacttgcctgggcaggtagacacactcgggaggaggtagcaaaaatgattcctgagcttaagtcagctattacaaggctgtgtctggttctccagctctagagatgcccaatgcacaagactcccgatggaaagagaatgccgatggagttgggctgccaggccttttctcctaggttgcagcactggtggagaggagaggcatctggaggaggggagccatgtcaagcgcgtatgagcacacaccttctctctcgggtcctgggttcctttttgagccgtggatgagaaaatgagaggcgtaaacaggactgatttcaaacgttctgcctaactatcatggcaaagagaaggaagtcatcccctagagtgatgaactagcttcttcagaactttcttggaatgagaagaaaatttaattaatccagggttattaaatggattattactaattatattattaaa

SEQ ID NO: 67978 - DNA, 480 bp, Homo sapiens
gaaaaaaggaaaataaacctcacctacggtttcttcacaaaggtcaggcaagaaagaattattcaggaactcacccaggccctccagagtgaggtgcccccagggctccctggaatggccctagcacgcacacggcggccaccttggcgaccacagtggcggcacgggactctgtctctttagaggcccagatggagacagtgcaccccgagttgctcaggcctcccctgaacctgttacaaccttcactaaatccacaaccacacacggcttcatgggtcccacgtcagcaaaacgtcccatgtcagctgctttcgaccttcatttctttgctttcagaggaaaaaacaccccaaagacaggtaacaagtgtgacttgacagtactgcgacaatactcctgtttgtgaaactcggaacacaagaatctggaggctgtgtctccagcaaatgtccagagcgtactgttttatgtattcaa

SEQ ID NO: 67979 - DNA, 310 bp, Homo sapiens
aaaggtagccccacatggggttcagcacccttagaagtgtacaacatcaagctcatttttgtttagactttctattgtggatttccacctttaaaaaatcttgctttaagatgctggggttggggggcatggggctgtctcagaggaatgcaattcaaatcttatgagaaatcagtatttgttaaatcctgtgactgaaataaaaacgtctcctgcggggcgtggtggctcacgcctgtaatcccagcactttgggaggctgaggcgggtggatcacgaggtcaggagatcgataccatcctggctaaca

SEQ ID NO: 67980 - DNA, 149 bp, Homo sapiens
gggacccttaagttcagagtcttctgggaaatctttttattcattcatccattttcacatatattttgggtgctgaatatgtgccaggcactattttagtcatcagggataggggcattgaataaaagaagtattcctattctcagaaa

SEQ ID NO: 67981 - DNA, 821 bp, Homo sapiens
taaaacttcggctagtagaggctggtgttaattcggccgaggctcatctttgccagtacaggagctcgtgccgtggcccacagcccacagcccacagccatgggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtgcggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaacaacccaaacaccacacaaccacaccaccaccaacacaccccacagagacgcaaacaaacgaaaaaaaaagagactgacgagcacgaggacaagcgcaccgacacaatcaccaacgagaaacaggagccccaaggcggctaaacaaaaccgccacatacaaa

SEQ ID NO: 67982 - DNA, 870 bp, Homo sapiens
cgcaggctcgcgcacgccccctgacgtgtgtcctcaggcttataatagggccggtgctgcctgcggaagccggcggctgagaggcagcgaactcatctttgccagtacaggagctcgtgccgtggcccacagcccacagcccacagccatgggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtgcggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaacaacccaaacaccacacaaccacaccaccaccaacacaccccacagagacgcaaacaaacgaaaaaaaaagagactgacgagcacgaggacaagcgcaccgacacaatcaccaacgagaaacaggagccccaaggcggctaaacaaaaccgccacatacaaa

SEQ ID NO: 67983 - DNA, 924 bp, Homo sapiens
acgcgtccgtgcagcggaggcttcctgagccccctggagagcctggcctgggcccgggtgtggagaccctcccgggctttcaatccgggcaggaggcagatggcagactcagcagtcacgaatcgcttaattctgaaagtctggtgagaagacacggcgagaatcggggtccagcacagatgatggcgacagcggagaagggaagggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtgcggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaacaacccaaacaccacacaaccacaccaccaccaacacaccccacagagacgcaaacaaacgaaaaaaaaagagactgacgagcacgaggacaagcgcaccgacacaatcaccaacgagaaacaggagccccaaggcggctaaacaaaaccgccacatacaaa

SEQ ID NO: 67984 - DNA, 359 bp, Homo sapiens
ggtgggcctggggctggcgccgcagtctctgaacctgtgtgacgcctgcagggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtgcggctgacgcagaccgt

SEQ ID NO: 67985 - DNA, 377 bp, Homo sapiens
agggtcccccttgccagccagggcctgggccccggcagcacggtcctgctggtggtggacaaatgcgacgaacctctgagcatcctggtgaggaataacaagggccgcagcagcacctacgaggtgcggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggc

SEQ ID NO: 67986 - DNA, 833 bp, Homo sapiens
cgcaggctcgcgcacgccccctgacgtgtgtcctcaggcttataatagggccggtgctgcctgcggaagccggcggctgagaggcagcgaactcatctttgccagtacaggagctcgtgccgtggcccacagcccacagcccacagccatgggctgggacctgacggtgaagatgctggcgggcaacgaattccaggtgtccctgagcagctccatgtcggtgtcagagctgaaggcgcagatcacccagaagatcggcgtgcacgccttccagcagcgtctggctgtccacccgagcggtgtggcgctgcaggacagggtcccccttgccagccagggcctgggccccggcagcacggtcctgctggtggtggacaaatgcgacgaacctctgagcatcctggtgaggaataacaagggccgcagcagcacctacgaggtgcggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaaaaaaaaaacagcaacaaaaaaaaaccggggggctcaatccgggggcggcaacaagcgccctgccacagggccagggccaacacggcccgcacccatttcggccacaggggaccccgcgggcccaa

SEQ ID NO: 67987 - DNA, 470 bp, Homo sapiens
gcggccgctccaacatcagaatggtgcagcacctacgaggtgcggctgacgcagaccgtggcccacctgaagcagcaagtgagcgggctggagggtgtgcaggacgacctgttctggctgaccttcgaggggaagcccctggaggaccagctcccgctgggggagtacggcctcaagcccctgagcaccgtgttcatgaatctgcgcctgcggggaggcggcacagagcctggcgggcggagctaagggcctccaccagcatccgagcaggatcaagggccggaaataaaggctgttgtaaagagaaacaacccaaacaccacacaaccacaccaccaccaacacaccccacagagacgcaaacaaacgaaaaaaaaagagactgacgagcacgaggacaagcgcaccgacacaatcaccaacgagaaacaggagccccaaggcggctaaacaaaaccgccacatacaaa

SEQ ID NO: 67988 - DNA, 621 bp, Homo sapiens
agactaaataatattccattgtatgtatatgcttaccacattttgtttatccattcagccatcaatggatatgtgggtggctgcattgctcattactgccaccccaggaaggtcgtatagtggttaaatctgtgctcattacacctgggtatctcttaggagtttcttgtttgccctcttgtgtaattacggtcttgtttttttcagtaatgtcctgtttgcccttcttatcagcatctatctagctacattctgacaggataactgcaaactgaatgattcctgggcatcataatggatgtttctttctacttaggtgtctcccctcctctctgcttatatctagcatgcctgttttgggtggtccctggggttgtgggatttcccaggggctacccttcctgctcttggctagatatctgccttctctaacaatgtcatcaaagattacactttgggaacaggcattttcaaggatacacagcttcaggactgctaatgttaacttttttctgcatattaattcatagtactctgttatgacaggtgctacagacccacagtccaaggagacattagggacagcccaagcagctgacagagcgatacactatcacaaaa

SEQ ID NO: 67989 - DNA, 2973 bp, Homo sapiens
agtcccagcggcgcagccacccatgcgcgcgcgctcgcaagaccaccagcgcccagagccccagtctgaggcttggcgccgggggtctgcgggcgaggggagctctctacgtgcgaggggctagcgggagccggcacaagagggtcgaggagccaggaaccccaaacgtccggcgccaggcgctagccaagctgctgcgcgccccggcgcccagctggctcggggacagccgctgggtgtcggagaccggagctagcggattgcagcggaaaagcaaagatgtcacactggatccttggcctccagggtccattaaggtgagaataagatctctgggctggctggaactagcctaagactgaaaagcagccatggacatggcggatgagccactcaatggaagccacacatggctatccattccatttgacctcaatggctctgtggtgtcaaccaacacctcaaaccagacagagccgtactatgacctgacaagcaatgcagtcctcacattcatctattttgtggtctgcatcattgggttgtgtggcaacacacttgtcatttatgtcatcctccgctatgccaagatgaagaccatcaccaacatttacatcctcaacctggccatcgcagatgagctcttcatgctgggtctgcctttcttggctatgcaggtggctctggtccactggccctttggcaaggccatttgccgggtggtcatgactgtggatggcatcaatcagttcaccagcatcttctgcctgacagtcatgagcatcgaccgatacctggctgtggtccaccccatcaagtcggccaagtggaggagaccccggacggccaagatgatcaccatggctgtgtggggagtctctctgctggtcatcttgcccatcatgatatatgctgggctccggagcaaccagtgggggagaagcagctgcaccatcaactggccaggtgaatctggggcttggtacacagggttcatcatctacactttcattctggggttcctggtacccctcaccatcatctgtctttgctacctgttcattatcatcaaggtgaagtcctctggaatccgagtgggctcctctaagaggaagaagtctgagaagaaggtcacccgaatggtgtccatcgtggtggctgtcttcatcttctgctggcttcccttctacatattcaacgtttcttccgtctccatggccatcagccccaccccagcccttaaaggcatgtttgactttgtggtggtcctcacctatgctaacagctgtgccaaccctatcctatatgccttcttgtctgacaacttcaagaagagcttccagaatgtcctctgcttggtcaaggtgagcggcacagatgatggggagcggagtgacagtaagcaggacaaatcccggctgaatgagaccacggagacccagaggaccctcctcaatggagacctccaaaccagtatctgaactgcttggggggtgggaaagaaccaagccatgctctgtctactggcaatgggctccctacccacactggcttcctgcctcccacccctcacacctggcttctagaatagaggattgctcagcatgagtccaattcagagaacggtgtttgagtcagcttgtctgattgaatgataatgtgctaaattgattacctcccccttaaagcgaacactgaaatgcaggtagacaattcaaagtctggagaagagggatcatgcctggatatgatctttagaaacaacaaaaatagaaaaaaataagtatctgtgtgtttgtgtattgaaaactcaatatgtaatcttgtgtttttatatgtatacttgtatattcctatttattctctgtataggcattacctacgttcctgtgtttacatacacaagtagcaaattcgagtatgcatagtgtagatggacatttgccacaacacactgcccgcagaaatggacttaccgtgaagccaataaagttcaagcttcagggatctctcttgcacgggccttgccaaggcccaggagggacttgggcagtatgttcatgtggtcatatgtttttgtaaaaaattgtgaaagtaagatatgtttgtattgtttttcttaaagaggaacctcgtataagcttcaagcctcacaaaccttctagcctctgcccttggggatttgcttcattaatttcaggcaagtgaggtcaatgtaagaagggaaagggagaagatatttgaagaaccagaatgtaaattcatgtgtttccacttctcagatatagtcagagaattattcatttgcccaaaaggacttaagtggttgtggtcatccatcattgtatttatcaagacaaagccaactttgttataagattgcatttttttcttttcaaattgctttagtttttcttagggagctatgagggggaaaaatcactaacatgaaaggcaaaaaatggactatgattcctgtggggaaacaatttcattctctccatcgtgaaaataagtgaataagagtgaagcaaaattacacctttatgagaaaccataaaattgtttttatttttcaggccagacatagcttcctaatgaaagaaaatggaaatgtaattcgacgactcctcaaaggggactttagaggacttcatacaaagctgggcattaagaaaaccacaatgcatggccgggcgtggtggcttacacctgtaatcccagcactttgggaggccgaggtgggtggatcacccgaggtcaggagttcgagaccagcctggccaacatggtgaaaccccatcactactaaaaatatgtaaattagtcgggcgtggtgtcacgtgcctgtaatcctagctgctcgggaggctgaggcaggagaatcacttgaacttgggaggtggaggttgcagtaagctgagattgtgccactgcactctagcctgagcaacaagagcaaaactcagtctc

SEQ ID NO: 67990 - DNA, 2123 bp, Homo sapiens
cccttgctgccgcctctcgcctcacgcccccagagaagagtttctccaccaggcagcaggtgaaggtttttttccaagtcacatgattcaggattcagggggagaatccttcttggaacagagatgggcccagaactgaatcagatgaagagagataaggtgtgatgtggggaagactatataaagaatggacccagggctgcagcaagcactcaacggaatggcccctcctggagacacagccatgcatgtgccggcgggctccgtggccagccacctggggaccacgagccgcagctatttctatttgaccacagccactctggctctgtgccttgtcttcacggtggccactattatggtgttggtcgttcagaggacggactccattcccaactcacctgacaacgtccccctcaaaggaggaaattgctcagaagacctcttatgtatcctgaaaagagctccattcaagaagtcatgggcctacctccaagtggcaaagcatctaaacaaaaccaagttgtcttggaacaaagatggcattctccatggagtcagatatcaggatgggaatctggtgatccaattccctggtttgtacttcatcatttgccaactgcagtttcttgtacaatgcccaaataattctgtcgatctgaagttggagcttctcatcaacaagcatatcaaaaaacaggccctggtgacagtgtgtgagtctggaatgcaaacgaaacacgtataccagaatctctctcaattcttgctggattacctgcaggtcaacaccaccatatcagtcaatgtggatacattccagtacatagatacaagcacctttcctcttgagaatgtgttgtccatcttcttatacagtaattcagactgaacagtttctcttggccttcaggaagaaagcgcctctctaccatacagtatttcatccctccaaacacttgggcaaaaagaaaactttagaccaagacaaactacacagggtattaaatagtatacttctccttctgtctcttggaaagatacagctccagggttaaaaagagagtttttagtgaagtatctttcagatagcaggcagggaagcaatgtagtgtggtgggcagagccccacacagaatcagaagggatgaatggatgtcccagcccaaccactaattcactgtatggtcttgatctatttcttctgttttgagagcctccagttaaaatggggcttcagtaccagagcagctagcaactctgccctaatgggaaatgaaggggagctgggtgtgagtgtttacactgtgcccttcacgggatacttcttttatctgcagatggcctaatgcttagttgtccaagtcgcgatcaaggactctctcacacaggaaacttccctatactggcagatacacttgtgactgaaccatgcccagtttatgcctgtctgactgtcactctggcactaggaggctgatcttgtactccatatgaccccacccctaggaacccccagggaaaaccaggctcggacagccccctgttcctgagatggaaagcacaaatttaatacaccaccacaatggaaaacaagttcaaagacttttacttacagatcctggacagaaagggcataatgagtctgaagggcagtcctccttctccaggttacatgaggcaggaataagaagtcagacagagacagcaagacagttaacaacgtaggtaaagaaatagggtgtggtcactctcaattcactggcaaatgcctgaatggtctgtctgaaggaagcaacagagaagtggggaatccagtctgctaggcaggaaagatgcctctaagttcttgtctctggccagaggtgtggtatagaaccagaaacccatatcaagggtgactaagcccggcttccggtatgagaaattaaacttgtatacaaaatggttgccaaggcaacataaaattataagaattcactataccttcccctccctggaactcaggatccaagtctagaaaatgaaaggactgggtttgaattgcttcaaaacctcttccatctcagaagaccagaccctgggaactgagattccagacacaattttggaagctctccaac

SEQ ID NO: 67991 - DNA, 1438 bp, Homo sapiens
cccttgctgccgcctctcgcctcacgcccccagagaagagtttctccaccaggcagcaggtgaaggtttttttccaagtcacatgattcaggattcagggggagaatccttcttggaacagagatgggcccagaactgaatcagatgaagagagataaggtgtgatgtggggaagactatataaagaatggacccagggctgcagcaagcactcaacggaatggcccctcctggagacacagccatgcatgtgccggcgggctccgtggccagccacctggggaccacgagccgcagctatttctatttgaccacagccactctggctctgtgccttgtcttcacggtggccactattatggtgttggtcgttcagaggacggactccattcccaactcacctgacaacgtccccctcaaaggaggaaattgctcagaagacctcttatgtatcctgaaaagagctccattcaagaagtcatgggcctacctccaagtggcaaagcatctaaacaaaaccaagttgtcttggaacaaagatggcattctccatggagtcagatatcaggatgggaatctggtgatccaattccctgattactgtggcatgatcctccaccattcacactctaccctggactctgggaagggacactgctgccttgaaactctacaaccctgaaccttgatgctggttgctgcagacaagaactgcttctaccctgggtcactgtcactgctaagtggaaagtcatgaacttgatggtaccagtcactctgggcctaaaccgacatagccaggaaacggttcaccccccacaaacagaatcatctagacctgtccatgatttggaatcgtggcccaatacttcctggccccagagagagaaaaaagtctgaccaccccctactcaaagtgccaactcatttccttcccagaattaatcacttcccaaaatgtatgactgtgtgaacatcaattcccttcaggggaaaaccccactcccacctctcaggctgtcatcttaccctatgaccccaacctgacaatcatgcaacagcccattattggtaccttttccaatgtttaggtgactcattcttatctacaatcactttgttgttctaggaaagtttttgacacagcaggcatttgatatatatttcttgattaaatgaaagattaaatgaataccatcttagatgtctgcatagtgctttaaagtttacaccactattctttcaaatagtacaagagagaactaagctgtgtactcaactgggaagaagcagaactgagagtgggagcacctggtattctgatttcttgtctagaactatactatattctgagatcactaaactacaacctcaggcgactctgcctacttttgtaaataaagttttattggaacacagccacattcattcatttatg

SEQ ID NO: 67992 - DNA, 266 bp, Homo sapiens
gtgttttagtgaatgagttaatacagaaggttcagagtaaattcttctatacagttatatctaataagataactagagatgtctaactacaatgagaccagaatagagaaaggagattaaaagttaagcaagtggaatttagaaaatgtttatagggttctatgtaatagacaattaagcataagactcaattttaaagaaaattgttgaataattatttctatagtcccttaaaaatagtactttttcctaatttgggatatgta

SEQ ID NO: 67993 - DNA, 145 bp, Homo sapiens
gtaaattcagtaaagtctcaggatacaaaatcaatgtacacaaatcactagcactgctttacaccaacaatgaccaagctgagaatcaaatcaataattcaatcccttttaccactgaaaaaaaaaatcaaatacttaggaatat

SEQ ID NO: 67994 - DNA, 289 bp, Homo sapiens
tagctatatgggaggaataagttctgttgtagtgctctatagctggtcgcatggaaataactataatttatggtatattttcaaaaagctagaagagaggattttgaatgttgtcaacacaaaagtatgataaatgtttgaggtgtttgaaatgctaattaccctgatttgatcattatgcattgtacacctgtatcaaaatatcactctgtttccataaatatgtacaattattgcatgccaactaacaataaaaggacaagataaagattcaaaaaataggaagaaa

SEQ ID NO: 67995 - DNA, 406 bp, Homo sapiens
cgaagattcaaaacctacaaaagcctgccgcagacattgaagaaccaatatatacaatggacaaacaatccagtgccggcggggtgaagaggagcgtcccctgtgaatccaacgaggtgaatgagacgatgccggagaccccaactggggactcagacccgcaacctgctcctaaaaaaatgaaaacatctgagtcctcgaccatactagtggttcgctacaggaggaacgtgaaaagaacatctccagaggaactgctgaatgaccacgcccgagagaacagaatcaaccccctccaaatggaggaggaggaattcatggaaataatggttgaaatacctgcaaagtagcaagaagctacatctctcaaccttgggcaatgaaaataaagtttgagaagctgatg

SEQ ID NO: 67996 - DNA, 143 bp, Homo sapiens
ttagaatataaggtcattgaagtagaagtaaacatacaaaaatctagggtagcaggaagctgatttgttacggtgattaaaagatttccaaaccaaaaacagaagagatatttaaaatatcactatttgtaattaaccttatg

SEQ ID NO: 67997 - DNA, 806 bp, Homo sapiens
aggaagccctggaagctgcttcctcagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccagggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcaggtaggaaggagcctccccgcctggggctgtta

SEQ ID NO: 67998 - DNA, 868 bp, Homo sapiens
aggaagccctggaagctgcttcctcagacatgccgctgctgctactgctgcccctgctgtgggcaggtgagtggctgtggggagaggggttgtcgggctgggccgagctgaccctcgtttccccacaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccagggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcaggtaggaaggagcctccccgcctggggctgtta

SEQ ID NO: 67999 - DNA, 714 bp, Homo sapiens
tagagtcccagccactcgggaggctgaggtgggaggattgcttgagcctgggaggttgaggctgcagtgggccatgattgcacaacttggcaacagagtgagaccctgtctctaaatcaatcaatcaagcgagccagaatgcagtagtggcctgagagaggcatcctggaacgcagtgcggtctggctaggcttagaagtattcatgtgatttttacctgacaagggaaggaagagctgctccacgtgcagagcaaggtttcagaatgagaggagaagagcaggcactgcagagggtgagggaaagggcagcagtggactgggaagccctcaggtggaggtcagcattgcttccctcagatcatgggtgaatttgaggaactcagttaatatctttgtatgttcctccctccataaggtgagaacaagcacatgctctgcccatgtcagaaattgtctagactagtgtttttcaaagtgcaaaagcctcaacccattactgagttgagaagccaacttaatggtttaacaggattgaccagcattttttccgaaaaaatcaaaaacatctgagtgtactgcatatagaaataggtggttttgcctcatgaatattctgtttctgtgtgttcctatattttactttgtattgtgttggttttttaagagacagtccagcctgggtgacagtgagtctttgtctcaaagaaaaaaa

SEQ ID NO: 68000 - DNA, 432 bp, Homo sapiens
cagctggcctcacttgtcaacatgaaatatagtaatgtatgcttctagtgggtgttcaccttcggtgaagactgctggggtcagacggtgggaatcatacaatcaataagtgaaagctgcagaatgctaaagtaccttaaatctatgcggctcacatctcaaaatgcatccaaattacccagggatctttaaagtgctgcttatgactccggcctcagtgaaactgagggtcagccttgctggcatgctcccgactgaccccagcgctggccagtggcaaggctctaaattctagttcgtagtattggtgcctattaatgctgctccaaggagtacttcttgatcctttgtgtttaaaaacgatgttttcccaatccccaagcccacagggctggagacaattcttctgcaaataaattacattttaatgta

SEQ ID NO: 68001 - DNA, 676 bp, Homo sapiens
gtatgcctctttataagtaaggtggcattattacttgagctggtggaaggcagcacgtttcccacaattggtctcaaaagcccgggatgcctgctgagttgccatttagtttattaccttagcaaagcagagttgggggtgcgattgtcgatagtaggctttgggagaaatgattgttatatttcgtaataaatgatgtccttgagaaactcataagttgcagtgtaatcctgtcttaattgtgttgagcacgactcccactgcaataccttaaataactgaaaacatttgcctttgaaagccccaatcgacttggacaataaaaacagttgcatgttttgctctagagatattttctgccgtttccatcattccactgcctggttattcctagggagaataacagataggatactggggcttcaccactatttgatcaggtatcagtttgaaatagagaatctctgccttatgaagatagtaattcctgtagttagcatgaaaacaaattgccagtttgattttctaggacagctcaagcagaatttgtaccactaggctgtaagttttaagtatctaattttctgatttgaaagtgtatgatttaaaaattggaaaaagtttttgttataagcttcaaaaggatttactataattacaactacgtaaaattaca

SEQ ID NO: 68002 - DNA, 413 bp, Homo sapiens
cccatttatgtggcagtgtccacacttctccctagattgggctgctcggatatgcaaatatcttcagggctgtccgcagtatctatgtttttttatgaaacagcatgtttcactggcatggatactcaggaactagatttgaactcacccattggtctgcactattctataaagatctgagtttgtaaatctatttctaaaaacattaggcctcttccccaatatgtcctcaagagttgtgctgatctaaccagatccataacccctgggaagctcccaaatttgaaacatcactaaaatccatccaaggatcaaaaatctgagtctgcgagcaagaacttccaaatgaactggcatcttgtctggtaatacacaagctctggacctatgaaagaaggcagagtgcaatgggg

SEQ ID NO: 68003 - DNA, 175 bp, Homo sapiens
ttcttggcagctgtatgggaaactcactcactgtccgtaggaatgtaagctggtgggatatttttggaagattggtgatttgacaagatctctcaaaattgaaaacatagaatcctttggcctagcaaatttagtgattagaatttactcattagatacagaaatgtacaccaag

SEQ ID NO: 68004 - DNA, 476 bp, Homo sapiens
ccctttcaagtagcccagggatgaaatgcattattcaataagttctgttctctccagtgcccaaagaaatttgggagatgcagtgactctgctttagaagagaattggagatgatcatgtgttcataggaagtgtgcattacattttgaactgaaaactccccagaaaggaaacatgtaataaacagcaaggcgacttagaatgaggttcggaggaggtgaaccttcagtcctaaaccactgttctttcaacatgtagcaacccatggttacctggggagattgttccaaatgcaggttccctgccatccctagaggattctgatttttgtattcagaaatctggaatttgcaggtgaccttaatggacatcgaccctgagaattaccagcctagaggttctgcacaccttcctcaaggaccatacattacaaatgatatttctaaaatgtcatttaatctcattctaaatgaaga

SEQ ID NO: 68005 - DNA, 1747 bp, Homo sapiens
  misc_feature (805)..(805): n is a, c, g, or t
  misc_feature (1115)..(1115): n is a, c, g, or t
agagagcacattatatcccaactgtttgctcagcaagaaccactggaacttatagatcaccaccttggaatcagacagtgtgggttcatatccctgctctgccacttgttaattacttagttttgataagcctcagcttcctcatcaataaaattaggaaattataatacagtaataataattgtaactgccccataaatgtggggattgattgattaccatcctattggtggttatttttattattaagacaaacaatgatatttatagtaaagatggtgatgatacaaacccctaaagcaaggtgttgtactcatcaagcagaaataaaaataaattatgagatgcgggaaattgaatattgtaatatgtgagcaaacaaagaaggtaaactattaatgaggatccctaacagttaaatatgtgtatctacatctaatactgtctgtcgggtaaaatactaagcacatagtgccagacagaaagtatttttttaaaagctattcattcatttccttaattttctctcacataattatctaactaataatttaagaatgaagttataataatagaaactaatcaaataccaaagtataagttaatccctaaatctctttgaataagccgtgtagtacagtgacattaggacaatctttgaaaatagatttgaattcaaatttctatttttcctgttattactttgcataagttacttctgagtctcactattctcatttataaaaagggcaatctaatacccgctttgttgagctactatgaagattggatgaaataatgtagnaacactctcaatattgtatccactcatggtagaaattcaataaatggtagtagtagttattattatccctgcgattgatattgttatcattattataatcaataaatatattacagaaaaattaattctatcattatcagggataaaagcctaagaattaaaactgtgtttataaactcagcttattttagtggcagtaaacattagtgtatcctttaaatgaattttattgaacatatcctgtgtgtcaagcacatgatggtaagcaaaatgaacttggtcccagctctaatgttgttttaaatatggngaggagattaaatacctgcaaaaaggcaacaaaaataaatggtaattagtgcttctcttgaaaaagtaggggtgagacaaaacacttaacctagacttgtgaggaaaagctgagtttgggtatggcactgagaggcacccaaggaaaaggaaggataaggcttttctagaaacaacactgaaaagcctcagaagccacatagatagtgatacattccagtaacagaaaaaagaaaagtatgttgagatttgtagagtgaaaaaaaaatagtggtaataaatggggttagagagatgattttaagccttatcatgctaggttttgtgaatattaagaaaaaggggcagggtgcggtagctcacacctgtaatcccagcactttgggaggctgaggcgggcagatcacctgaggtcaggagttcgagaccagcctgaccaacatggagaaaccccatctctatgaaaaatacaaaattagtcagcgtggtggcgtgtgcctgtaatcccagctactcggggggttgaggcaggagaattgcttgaacctgggaggcagaggttgcagtgagccgaggtcgtgccactgcactccagcctgggcaactagagcaaaactccatctaaaaaaaaaa

SEQ ID NO: 68006 - DNA, 865 bp, Homo sapiens
gttttgttttcctgccgaccccagcttacccaggttttaagaccactcacttggagaatttcacttgctttccagctcagctctctatttcgaggttctaccactctaagccatcccacaccctctttacacagctctgatcctattgcttttctactcaaaacagaagtggctccccattttcaagtgaattaggactctacgaatttaattccaatcttttacaaccttgcttttattactttccctctacacgtattctgtgatccaactcaagacctgatgttttccacacacaccctgtgctttcttactaatgtgtttttacttctgatgttctcccctcactgaaagtatctttgtctctagcctttttataaaacttcctttttttctcattactcctctctggaaataataaatttaaagattttttgggaaaaagtctcccagtaacattaccaatatatgtgttacagacttaaccagacaagtacagacctttgtgaatacattcacgtaattttactgaaagccataaaaatttaaaaacagactgaagaaaagaaaaacccaattttaaaaattgggtaatgggcttgaatagacatttctccaaataagacaaacaaatagccaacaggtgccaacatcactaatcatccagggaaatgcaaatcaaaaccacagtgagatagcccatcatgccttttaggatggctgttaataaaaactaaaaccaaaaccctaccacatggaaaatagcaagtgttgacaaggatgtagaaaaaatggaaccagttagcaccatcagtgggaatataaaatggtggagctgctatggaaaacagtagggagtttcttc

SEQ ID NO: 68007 - DNA, 966 bp, Homo sapiens
  misc_feature (551)..(551): n is a, c, g, or t
  misc_feature (625)..(625): n is a, c, g, or t
  misc_feature (708)..(708): n is a, c, g, or t
ggcatgtctcggaggttggcatcacggaggcactgtgcagtccttgcaatgtcaaacttactcagtgccagcatagacggtggtctcatgcactccataggtttagggtactacaaggatctccagacagctacatttatggaagttctgatgaaaatccctcaacaaggcacagaatttgacacacttcagaaacggtattggctgatgggtttgagcaattggtggaactggtcacagtgatgggtgatcaaggagagctccctatagcgatggctctggccagtgtggttccttgttctcagtgggatgaactggcttgagttctggttactctatttggttcttggcatttactctaccaactgctctggaacatgttttgtaaagaagtagaattggcagactgactccattcagactctcctctgaggcaacagtttggccagtaaaataatgacactctgtttcaaggtgcccaagaattcccatccctccatggttcaaataatagagtattgccaatcatgttctcttcacaaaagaagagnatatgcggcctttcaatgattttgtgaaaagcagctttgatgcagcttgaagtgatgcagtaaatcatagcctntccttcagcagtgacggcaatgtgctcgctttacatcatctactccggaacaatcaggagaaaattggccagtgtctttctancaacagggatcataaagctgttggaagatgaccttttgataaatggcaacacttcttgtatacctcggtcctccagagcacaaacctgtggcagatacataccggtccagccttaaccttaccagttaaaagtttgaggaatttatgatgaggcatcaggtatgtgaaaaagaagagatcaaggctttgaaaacattaagtattttttaccaagctgggaattccaaagctgggaagccaattttttatgttgcaagg

SEQ ID NO: 68008 - DNA, 574 bp, Homo sapiens
gagcaagttactttaacttaggggttctccatttttgtgtggtgctaagaggtacatagggtggggggagggtagccatagttttcccagtccctccttaaatattccacctaggtaacatgcttgtgcttttgtttgcatatcagggtactcaacaccatacatacatatacagtccatagaacgtgtgcttactgttctgtaaggaaaactggaaccacgtcccacttggtgccctcattccctctaagcccattgtatatatacatcctggtgctggtcactttcctaatttgtgtaatacctgtctttggggggttttgtgaggactagcgacaatatttataaaagttttagaacagtctctaacatgtggcaagtattcagtaaatactatttttacatttcaatgattttattagatacttgattttacgatcattggtggaacccactgttacttctttgtacttaaaatactccgtcactgagatgtgttttattccattgccacagtggttcttaagttctctaattccaagatgatcctgcctgttgggtaatcactgtcccc

SEQ ID NO: 68009 - DNA, 474 bp, Homo sapiens
tagctactcccaaaaaactagattctactcagactacacattcttcaagtcttattgctggtcacacagggccagtaccaaagaaaccccaggatttagctcatactggcatctcttcaggccttattgctggttcttccattcagaaccctaaagtttctttagaacctttgccagccaggctacttcaacaaggacttcagaggtcaagccagattcacacttcttcctcttcacagacccatgtctcctcttcttcccaagcccaaattgctgcctcttctcatgctctgggaacatccgaggcccaagatgcttcttcgttaacacaagtaacaaaggtgcaccagcattcagctgtccagcagaactatgtgtctccattacaggccaccatcagtacgattgtcaaacgacgcccggtggacgctagcatagcaagcagcaagatctctagacgatacacgggcccga

SEQ ID NO: 68010 - DNA, 183 bp, Homo sapiens
aactcaagcggagctaataggactagtctgtctgggggaacaggaagtggaacacagggtgctaccaaaccattgtctactccacatagaccatccactgcctcagggtcttcagtggtaacagccagtgtgcaggtatgtatgttctgtacgtccatgtgataaactataagattgtataat

SEQ ID NO: 68011 - DNA, 1735 bp, Homo sapiens
tagctactcccaaaaaactagattctactcagactacacattcttcaagtcttattgctggtcacacagggccagtaccaaagaaaccccaggatttagctcatactggcatctcttcaggccttattgctggttcttccattcagaaccctaaagtttctttagaacctttgccagccaggctacttcaacaaggacttcagaggtcaagccagattcacacttcttcctcttcacagacccatgtctcctcttcttcccaagcccaaattgctgcctcttctcatgctctgggaacatccgaggcccaagatgcttcttcgttaacacaagtaacaaaggtgcaccagcattcagctgtccagcagaactatgtgtctccattacaggccaccatcagtaaatcccagaccaaccccgtcgtgaagttaagtaataatccccaactctcctgttcctcctcacttattaagacttcagataagccacttatgtaccgccttcccttatctaccccctcacctggaaatggttctcaagggtcccaccccctggtttctaggacagtacctagcaccactacctccagtaactatttagccaaggctatggtgtcacagatctccacgcagggtttcaaatctcccttctcgatggctgcctccccaaaacttgccgcatctcccaagcctgccacatctcctaaacccctgccctcgcctaagccttctgcctcacccaagccctctctgtcagctaagccttcagtatcaactaaacttatttctaaatccaacccaactcccaagcctactgtatccccaagtagttccagtccaaatgcactagttgcccagggtagccactccagcactaacagcccagtccataaacagcccagtggaatgaacatcagcagacagtctcccaccttgaatttattgccctctagtcgcacttcaggccttccacctacaaaaaatcttcaggccccctcaaagctaacaaactcatcatccactggaactgttgggaagaacagcttgagtggaattgcaatgaatgtacctgccagcagaggtagcaaccttaactcaagcggagctaataggactagtctgtctgggggaacaggaagtggaacacagggtgctaccaaaccattgtctactccacatagaccatccactgcctcagggtcttcagtggtaacagccagtgtgcagtccacagcaggagcatcattattggctaatgcctcacctctgactctcatgacatcacctttgtctgtaacaaatcaaaatgtgactccttttgggatgctgggtggccttgttccagtgaccatgcccttccagtttcccttggagatatttggctttggaacggacacagctggagtgacaaccacctcgggatctacctcagccgctttccaccatagcctaactcagaatttactaaagggtttacagccaggaggagctcagcatgcagcaacgctttcccactcacctctgcctgcacacttacagcaagcatttcacgatggaggccaaagtaaaggggacactaaattaccacggaaatctcagtgactgcccagcaagcaaaggagacgaaatgtttagttgactgatggaatctacctgatgggaaagtacttatgtggtcatagggctgctgtttctgtcgatgtttacattctctcgtcccaagcactgtggtgagg

SEQ ID NO: 68012 - DNA, 1289 bp, Homo sapiens
  misc_feature (1282)..(1289): n is a, c, g, or t
ctaagacatcatttcttttatcagatgaggaaaccaatacatagaaagacttttaaattttccctaaacaatggaagtacatgctaagtgcaataggggtatgtagaaaagagtgttcagattttagggagatttccagaaaaggcctcttcatgctggagatggctttttttaaataatggaagggagttcccaaggcaatggttgagcagtggagtgggagcccaggtaagagtatgcaggtggtagaaacaaaatattctaagacagacgggcacaaaacagcatggcttatttggggaactacaagtacctctatgttgctgatgcctgatgttctagaggacacatttcaaggcaggaacaagctgagggcatatctcaacctccccttcctcaggggcactcatccttcatccctttagcagttttactcagcatttgttctaggatgccaggctgtgaggtaagacaggtaagtgagactcagcctctaccctcagagttcacaatctaatgggaaaactaaattatcataaagatagcattacaaatgcagtgcttgacatatgcctggagcactatgagactgtaggtgagaagcaacgaaaagaggacaatccggagaaggtagcagctgtgctgtctcttaaagtctgaccaggtagtccaggtgttccctgtgtttgaggtcaaggggcagcaggagaagatgcaacagaaaagcacacagcacgagcaaagccacatagctgaaaaacagctatcacctgcaacagcttctgctgctacaatacctgtactcctcttagattttattccagtatcagccaacaacgtgatctgacaggacagtcccagccctaggaaatgaactatgattcgtgcagaccgatcgaagtcataccatacagcgatggatttgggcatgtgggccagttgggatcaagggaaaggaagcatttccattttgatcaatggggggattctgggaaagtcttctgcccgtaaaaagaaacaagccaggaaaaacgtccccttcctccctgtagacatggctatgaacggcaggatgcctgaaactgtccaggcttgttatgatggagagacacactgcacagggtgggggaaaggggaaatataccctaagaatggtagaccagaaagatgtaaagcatctgtatccttgttgaaattatagtgcctcccaattaacatacctagaactgtttacctctggacatttcattatgtgagatattaaagacctgtgtatttgaannnnnnnn

SEQ ID NO: 68013 - DNA, 683 bp, Homo sapiens
ccttcaaatgtcctgagcataatggtgtccaaaccctaaggtgccttctggtttctacaagaggtgtcaactgggttcctggtcttaggggcattggggatgtatttggaatcccgaaccaggcttccattaagatgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaagttaaaatgtct

SEQ ID NO: 68014 - DNA, 989 bp, Homo sapiens
cgagccgagaagatggagagatgcacctccatcctgaaagcgctgatcatgaaacttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctcccttgttttgtgggccatggaagtcttgtcatgttctggggggcaccaaattatgttcgaaacagttattgggggaagcccccctcggggggttaaaacacgaaggggcggttaaaacaaattgggtctgttttaaaagagttggttaaggttgggtataagaaaaagaggaatgaaaggtgt

SEQ ID NO: 68015 - DNA, 7646 bp, Homo sapiens
cggggctggcggggatgtgacgggcggccttcgtctcaccttccgtcctcgggcccgcaggtcgcagggcggctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctgggtgggtattctgctccctccttctctccttggcagggctccttccaggggatcccacggactgttccaccgcaccgcagacagacctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccaggtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaaatgtttcttattacatataaatcagttatatattcctttacatcttgttttacaaacacatgtgcatgcacacacacacatacacacacataccatttatgtttgtatttgttactgggtaaattttggagcgcttgagatacaccttgaaacctgtacctaaagatgtattcatttgtaacatatgttggtgctagagttttgctggtaattcaggtttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgaggtttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttaccgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaagttaaaatgtct

SEQ ID NO: 68016 - DNA, 7560 bp, Homo sapiens
cggggctggcggggatgtgacgggcggccttcgtctcaccttccgtcctcgggcccgcaggtcgcagggcggctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccaggtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaaatgtttcttattacatataaatcagttatatattcctttacatcttgttttacaaacacatgtgcatgcacacacacacatacacacacataccatttatgtttgtatttgttactgggtaaattttggagcgcttgagatacaccttgaaacctgtacctaaagatgtattcatttgtaacatatgttggtgctagagttttgctggtaattcaggtttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgaggtttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttaccgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaagttaaaatgtct

SEQ ID NO: 68017 - DNA, 5897 bp, Homo sapiens
agcgggatgctagcatagatgtggtagtggagggacagcttatagaaagttgagatggtcctaatgtaggtaaatagaaatctcaaactgatattgatactttcaggatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccaggtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaaatgtttcttattacatataaatcagttatatattcctttacatcttgttttacaaacacatgtgcatgcacacacacacatacacacacataccatttatgtttgtatttgttactgggtaaattttggagcgcttgagatacaccttgaaacctgtacctaaagatgtattcatttgtaacatatgttggtgctagagttttgctggtaattcaggtttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgaggtttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttaccgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaagttaaaatgtct

SEQ ID NO: 68018 - DNA, 5860 bp, Homo sapiens
agcgggatgctagcatagatgtggtagtggagggacagcttatagaaagttgagatggtcctaatgtaggatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccaggtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaaatgtttcttattacatataaatcagttatatattcctttacatcttgttttacaaacacatgtgcatgcacacacacacatacacacacataccatttatgtttgtatttgttactgggtaaattttggagcgcttgagatacaccttgaaacctgtacctaaagatgtattcatttgtaacatatgttggtgctagagttttgctggtaattcaggtttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgaggtttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttaccgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaagttaaaatgtct

SEQ ID NO: 68019 - DNA, 7103 bp, Homo sapiens
cggggctggcggggatgtgacgggcggccttcgtctcaccttccgtcctcgggcccgcaggtcgcagggcggctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccaggtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaaatgtttcttattacatataaatcagttatatattcctttacatcttgttttacaaacacatgtgcatgcacacacacacatacacacacataccatttatgtttgtatttgttactgggtaaattttggagcgcttgagatacaccttgaaacctgtacctaaagatgtattcatttgtaacatatgttggtgctagagttttgctggtaattcaggtttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgaggtttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttaccgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaagttaaaatgtct

SEQ ID NO: 68020 - DNA, 5155 bp, Homo sapiens
  misc_feature (70)..(70): n is a, c, g, or t
agaggggaagtgaaatgtaacgaatatggttttatatttctcaggtggggagaaagttgacgtgaaacgnctacccctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccaggtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaaatgtttcttattacatataaatcagttatatattcctttacatcttgttttacaaacacatgtgcatgcacacacacacatacacacacataccatttatgtttgtatttgttactgggtaaattttggagcgcttgagatacaccttgaaacctgtacctaaagatgtattcatttgtaacatatgttggtgctagagttttgctggtaattcaggtttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgaggtttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttaccgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaagttaaaatgtct

SEQ ID NO: 68021 - DNA, 7358 bp, Homo sapiens
cggggctggcggggatgtgacgggcggccttcgtctcaccttccgtcctcgggcccgcaggtcgcagggcggctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccaggtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaaatgtttcttattacatataaatcagttatatattcctttacatcttgttttacaaacacatgtgcatgcacacacacacatacacacacataccatttatgtttgtatttgttactgggtaaattttggagcgcttgagatacaccttgaaacctgtacctaaagatgtattcatttgtaacatatgttggtgctagagttttgctggtaattcaggtttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgaggtttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttaccgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctcccttgttttgtgggccatggaagtcttgtcatgttctggggggcaccaaattatgttcgaaacagttattgggggaagcccccctcggggggttaaaacacgaaggggcggttaaaacaaattgggtctgttttaaaagagttggttaaggttgggtataagaaaaagaggaatgaaaggtgt

SEQ ID NO: 68022 - DNA, 7137 bp, Homo sapiens
  misc_feature (6789)..(6789): n is a, c, g, or t
cggggctggcggggatgtgacgggcggccttcgtctcaccttccgtcctcgggcccgcaggtcgcagggcggctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccaggtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaaatgtttcttattacatataaatcagttatatattcctttacatcttgttttacaaacacatgtgcatgcacacacacacatacacacacataccatttatgtttgtatttgttactgggtaaattttggagcgcttgagatacaccttgaaacctgtacctaaagatgtattcatttgtaacatatgttggtgctagagttttgctggtaattcaggtttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgaggtttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttaccgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccactgatcttttacacctccgcttacttctctcgtcncccctctcccttcttacttttatcttctacatctttctctctttctcatgttctcttgatctcctcatgttcctctccccctctccccttctttttcacttccttacacttatcatcttcttcttccccctcttcctctctccctctccttcactcctccctctccttccttctatcttacttctcctcattctcgctactctttttctccgcctatcgttcctattcgtctccttcgtctctttttgtctctctgctcgactcccgtctttctccttcgcttcctctcaccccttcccttttactcctctctgtccctctctctacagctctctctcctcttactct

SEQ ID NO: 68023 - DNA, 1983 bp, Homo sapiens
cggggctggcggggatgtgacgggcggccttcgtctcaccttccgtcctcgggcccgcaggtcgcagggcggctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagtatgtatggatttatatactcttggaatattttgtttaccctactatagagagacttgtgatatgattgattttgtaaaaaatttatgaattaactttactactttgagaaatggaaattcatatttgttaagagcctataaaatatctgactctaatatgaaataaagcatggagaatatatgacatttgacttaaatatactcaacatgtt

SEQ ID NO: 68024 - DNA, 537 bp, Homo sapiens
ctgattgcgccttttgtggaaacacatcagtgactgaggtgagtggaagtcagagccatggtgataatgataagtgatttgtaataatcactgcaataatttcattatctttatttctttctgaaattgtattgtatatcttttccctccaccttcttccctgcccttccagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcaggtgagtacataatgaacatttccagctctgatattttgaattgcaaaatggattgactttagttttttttaaaaaaatacttactgggtttctcatgtctttttagatttctgtagaataatgcttgtaaatagtatatagtagaaagttttgtggaaaaaacctgtgg

SEQ ID NO: 68025 - DNA, 686 bp, Homo sapiens
agcgggatgctagcatagatgtggtagtggagggacagcttatagaaagttgagatggtcctaatgtaggatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaaataaaaacagatgcggccgaagccgctctcattatagttgagcactacaatcctgcactct

SEQ ID NO: 68026 - DNA, 5803 bp, Homo sapiens
tgggtacaactatgtctgagtaggcagccggtaacacaatgtctcccttgtgcaaagtaactctcttagtgagtgctcagatatgtgaggaaaaagtatttggtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccaggtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaaatgtttcttattacatataaatcagttatatattcctttacatcttgttttacaaacacatgtgcatgcacacacacacatacacacacataccatttatgtttgtatttgttactgggtaaattttggagcgcttgagatacaccttgaaacctgtacctaaagatgtattcatttgtaacatatgttggtgctagagttttgctggtaattcaggtttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgaggtttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttaccgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaagttaaaatgtct

SEQ ID NO: 68027 - DNA, 5435 bp, Homo sapiens
agcggagtcatttcaagtatccatgtccattgcagctgctctggaactcacaggaagatctcagtttttgcaaactcatggaagaatcacctggcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccaggtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaaatgtttcttattacatataaatcagttatatattcctttacatcttgttttacaaacacatgtgcatgcacacacacacatacacacacataccatttatgtttgtatttgttactgggtaaattttggagcgcttgagatacaccttgaaacctgtacctaaagatgtattcatttgtaacatatgttggtgctagagttttgctggtaattcaggtttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgaggtttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttaccgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaagttaaaatgtct

SEQ ID NO: 68028 - DNA, 5550 bp, Homo sapiens
agcggagtcatttcaagtatccatgtccattgcagctgctctggaactcacaggaagatctcagtttttgcaaactcatggaagaatcacctggcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttagactgcaccagttgtcctgaataatatctcatcttgaaaataatttttagaaagatttaagaaatattgaagagcatcctaaagaaagaaaagtgaaagcattaatctttatcagcaactcagcatatctgccaccaaaaatgtaaagaggaaaaatgcacttatgctgataaatatacccaaacaccctggagacgaattcctcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccaggtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaaatgtttcttattacatataaatcagttatatattcctttacatcttgttttacaaacacatgtgcatgcacacacacacatacacacacataccatttatgtttgtatttgttactgggtaaattttggagcgcttgagatacaccttgaaacctgtacctaaagatgtattcatttgtaacatatgttggtgctagagttttgctggtaattcaggtttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgaggtttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttaccgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaagttaaaatgtct

SEQ ID NO: 68029 - DNA, 5217 bp, Homo sapiens
ttgtatcaagtcaagtacacaataataaaaaaacccaaacacaaacacgctgggtgggtattctgctccctccttctctccttggcagggctccttccaggggatcccacggactgttccaccgcaccgcagacagacctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttctactagtttggctccttcattttatatcctggttgaagtacatgccatttgagcataattatctcaggtaaacacgaaagtttgcttacccatttcagaggcctgccaaaggcccaaatcatgttatccatccctctccaggtcagaaaattcataatattttactgagcaggcaagaagtgtgctttgctggtttagtcctattaaggtctgtatttattgtggttgtcagaacctcaccccttttcacttgtctctcctgtgaatatggctactattttaactaaagatatggtgataatggaagatggtagtctgtaagcagagttctggccagtgttttgtatatttaaaaggtctatgcaaaagctttgtgatgaataaaggagattaggcttttaatggaaagtctatgtaagttttatttttccttgccagggtcagtcagctaatgttactgttgattcatttcccaaattccccagactgaaaatgtttcttattacatataaatcagttatatattcctttacatcttgttttacaaacacatgtgcatgcacacacacacatacacacacataccatttatgtttgtatttgttactgggtaaattttggagcgcttgagatacaccttgaaacctgtacctaaagatgtattcatttgtaacatatgttggtgctagagttttgctggtaattcaggtttgaacccttaggcttgtggatccatgatagccattttaaggttccacagcattatgtctttaattgtaatatttatatttattgattttctgctaatatctgaagactgaaataatgaacttgaaacatttgcacaaaactttgatggggtataaatataccatatatagggattgtaaactattttctatagcaaaacaagttaaaatattttgagaaaaataacaaatttaaataagactatcttgagaaagctggagttcataatattctccccctcccccatctccagtctcctaggtttcccttttctgtgttttttgtttttttctgtttgttttttgagacagagtcttgctccattgcccaggctggattacagtggcgcaatctcggctcactgcaacttctgcctcccgggttcaagcgattctcctgcctcagcctcctgagtagctgggactacaggcatgtgccaccatgcctggctaatttttttgtatttttagtagagatgaggtttcaccttgttggtcaggctggtctcgaactcctgacctcaagtgatccacccacctcgtctatggtgtatttttgaaagacaattttttaaaggtagatttgggaaaaaaatagaattgaagatgggaaattttgttttattaaaaaggtgctagaagatgtttcaaagacaatattcttattttaatacgctgtagaaggtaggtgtggaacctccatgctaccatgtgcacaaacctaattatgctttgggtcacttgtcagttcagtaaatctgccttcctcttctcccaaatcatgtcatctttaggttgttcacctgcagctgctttaaatgaattagtatctttcagatagataaccttacaaggagaatgtttgttttgagcagctgaccaaaaatatatcaaacaggattatggccaaaaagtcactcaaatttctagagattcctttaaaagatgtatgttgatgaaattgcccctttataagaaaaacaacagcaagtcttttagtagaaatttgaaagaagtgtttgctaccattttgacccattattcccttacctatcagatgaatttgccattcactggatagaaaccattcttggatttggtaagaggtgagcaagacaaatcttgtaccatactcttatgtaccagcacttctgatggagaagcagtgaagttcagaacgttcttcacatagtccagatactgttagagtcaggcaaatcagcaaagcactttgttatggagatgacccatgatggctgcagttgtaagtgggcatacatgttctatcattttgaaggagaaagaaaaccgttctcacatgttgcaaatatgtgaatcatactatattcccctaaagtaaaaccagtgacttagtggtttttggtttatttagaagttggtttagacccttatgaaacattatttacgagttggccttatccttaagggaaaagttctaaatttttaaatttatttttaattccctagtctgagggaaatgtctttattgtccattacataaaaatgttgactccagtaatttatttttctctattttttcctccatgtatttactccatttttctctattttttccttccctgatggatttgcagaaatgttaaccaattagctcaacttttctctacctttgttgagtcttaatcttttagaagataggcttaccgtatatttatgaagcataatatattaaaagaaaacaaatctaggatgcttgcatgacataaagtatttgcctgcagttttcattaaaaactgcaagaatatcatgcttgtctgcttcttagtaaatgttaagtctgaaatggaagtgaggatgtaactctactgaataatcaaagatcatcttagatttggcttgatctgtgtttattgcttctattaatgtaaatcaactctgtgccaaatcctcctccacaaaccatttattgtcttagttctagtggtatcaatgaagatagttacagtatatgaattctaagtcctgaggaagaaattttatggggtttgttaagtttcacattcgtgaaagaggaaattagtagagtattcagactttgatatttggctgttaatgggatgcatatcaaatttttaaaagaaggcttggcctaaggagtttattggtacaggtgcagatgattttaaggcattaaaggattatagagttatgtcatttagactgtttctaataactgagaccatctaacatttttcttttggagtctcatttttatttgtgcaatattttcaggcatataggctactgttcattgtatttatatatatattagaatttactaagtactttaacaagtaaaaatctgaatatgaaagaaaatatcagatttgcactttaaatgagcttaattgcttgaagttgtgcctgaaatatcgaattgcctcctattgggtgtggctttgttgaaataaatttgtaattgttgctgtttgaagatatcagtacagctgttcacagaaatatattcccagcatgtcacttttccattaaagcactaagttttctttgaatgttccattgttccgataagtattttacttttttctcagtacatcagagagagcgtgatccccctacagctgtcacttccaaatgttcctgtagcataaatggtgttacagacactgaggtgcactcttggtttctgagcagagttgtcatactggtttcctggtctctagggcactggggatgtactttgaaatcaccgaacaggcttgcaattaagatcaataaggctgcagcaccatttcaatttactttccatcttacccagtagtttttgtgtttttaaattcgtttgggtggttatgtttgcatgcttaagcacacatttgaaaattaattatagctgtactacccgatgtttttccttggggatgatggccttgttcctttttaaattctgatgcttgaattctattttctagtgatttttcacatctccctttaagtttttgctgcagcaatttgagagagtacttttgattaaatgattctgatggtgggcaccaatctacaactatgtcattaactgaagatacatgttttaatcttgttgggaataagcttacccactttctccttggtaaagcgtttacttaacaaaataatacccgagaatgtaaggtctctaagtcattactaacaaagagcaaaaataatatctgcagtattgtttttcccattgattttaagtcagtttagagtacaaactgtatattagaatttgcctgtaaaatgaattctaaaaagcagatgtaaagtctctcctgaaaatgttggcatagtaaataaaaataaagttcataattataaagttaaaatgtct

SEQ ID NO: 68030 - DNA, 3439 bp, Homo sapiens
cggggctggcggggatgtgacgggcggccttcgtctcaccttccgtcctcgggcccgcaggtcgcagggcggctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaataaaacaacttaaagacgaaataaagaaaaaagatgaaaagatccaactattagaacttcagcttgcaactcagcatatctgccaccaaaaatgtaaagaggaaaaatgcacttatgctgataaatatacccaaacaccctggagacgaattcctcctcaagtactacagccttccagcagccttcccagacccacagatcacacccagggaaaactaataaagccacaacgtatcgaggcccgcagtgaatgctcaatccaagacatgcatcagggcggtgcacatccggaagaaagctttacacacgtcttgcaccaagaaagcaactatggtttggaagagcagcctttttcatcaggcccacaattaacaatggatgtggctaagagtacaccttctgaagcaaacttaaacattactgtaaatgctcaagagccttatcatttggcaaacaatcaaattagtgacatgcagtttatacccacttctcttcagacacctcccgagtcaagtacagtagaccaggctaagagagttggaagaaatcagtctccgccagtgggttatatgtctcagcccaagtccttgcagcttttaaagccatccatattgagttctttggtaccgcctccagtttctgaatcatctccaagtaggactcccacttgtaaaaagtcaccaataatcacaacatgtaattcagcaaaacttcagccaacatctagtcaaacaaatcttgcaaataatcagaatctgaaagcatctaagctccgccccccctcaggctctttcaaacaaaaacaaacaaacagcccccaactagagcctcaaagcttccaggccaagacaagcatcccaaggccactaacacaacgaaaagaaatcatgcagaatccaaatggcaatttgcattctggggattgtttggcctctaatcgatattctcgtcttcctaaaccaaagatacattaagtacatagccatcacctgccaatttgtttcttaaaaacaatctcttctgtaatagctttatgtgcagcttgcagcttgctactgtggtggaggttccattgaaagcctgcaaatcttaaattaaaatgtggaagcttcta

SEQ ID NO: 68031 - DNA, 2386 bp, Homo sapiens
cggggctggcggggatgtgacgggcggccttcgtctcaccttccgtcctcgggcccgcaggtcgcagggcggctgcagctgggccgcggccgaggaggcagcgcgacctccgcacgattctttcaacttttaagaacaaatgcaccttatagctcatggaagaaaaaacacaaatcaagacatttttgggttccaagttgccaaagtatggaacaaaatctgtaagaagtacattgcagccaatgccaaatgggacacctgttaatttattaggaacttccaagaatagtaatgtcaaaagttacatcaaaaataatggctctgattgtccatcatctcattcatttaattggaggaaagcaaataaatatcagctttgtgcacaaggtgtcgaagagcctaacaatactcaaaattcacatgataaaataattgatcctgaaaaacgtgttcctactcaaggaatgtttgataaaaatgggataaagggaggtttgaaaagtgtttctttattcacatcaaagttagcaaagccatccactatgtttgtgtcatctacagaggagttaaaccaaaagtctttttctggaccatctaatttgggtaaattcaccaaaggcacattattaggaaggacttcatattcttcgatcaatactccaaaatcacagttgaatggattttatggaaaccgatcagctggtagcatgcaaaggcctagagcgaactcctgtgccaccagaagcagttctggagaaagcttagctcaatccccagacagtagtaaatctattaattgtgaaaaaatggtaaggtcacaaagtttttcacattccattcagaattcattccttccaccttcatctataaccagatcacattcctttaatagagctgtggatcttacaaagccttatcagaaccaacagctatccattagagtgcctctacggtcaagtatgctaacaagaaattcccggcagccagaagtactcaatgggaatgaacatttggggtatggatttaataggccttatgctgctggtggaaagaagttggctttaccaaatggcccaggtgtaacttctactttaggttatagaatggttcatccctctctactgaaatctagccgatctccattttctgggactatgacagttgatggaaataaaaattcacctgctgacacatgtgtagaggaagatgctacagttttggctaaggacagagctgctaataaggaccaagaactgattgaaaatgaaagttatagaacaaaaaacaaccagaccatgaaacatgatgctaaaatgagatacctgagtgatgatgtggatgacatttccttgtcgtctttgtcatcttctgataagaatgatttaagtgaagactttagtgatgattttatagatatagaagactccaacagaactagaataactccagaggaaatgtctctcaaagaagagaaacatgaaaatgggccaccacaggatatgtttgattcccccaaggaaaatgaaaaagccttcagtaaaactgatgaatggatagatataagtgtctctgacaggagtgaatgtacaaaacatacttctgggaataatttggtttcaccagatacagactacagagctggttcttcgtttgaactctctccatctgatagctctgatggaacatacatgtgggatgaagaaggcttggaacccattggaaatgtccatccagttgggagctatgagtcctctgaaatgaacagcatagatattttgaataatcttgaatcatgtgaccttgaggatgatgatcttatgcttgatgtggatctgcctgaggatgcacctcttgaaaatgtggagtgtgacaatatgaaccgctttgaccgaccagacagaaatgttcggcagcctcaggaaggtttttggaaaaggccaccccagaggtggagtggacaggagcattaccacctcagccaccctgaccactatcatcaccatggaaaaagtgacttgagcagaggctctccctatagagaatctcctttgggtcattttgaaagctatggagggatgccctttttccaggctcagaagatgtttgttgatgtaccagaaaatacagtgatactggatgagatgacccttcggcacatggttcaggattgcactgctgtaaaaactcagttactcaaactgaaacgtctcctgcatcagcatgatggaagtggttcattgcatgatattcaactgtcattgccatccagtccagaaccagaagatggtgataaagtatataagaatgaagatttattaaatgaaaataaaaacagatgcggccgaagccgctctcattatagttgagcactacaatcctgcactct

SEQ ID NO: 68032 - DNA, 1116 bp, Homo sapiens
cagcacggccacgacacggccacttccagacagagcccctggctgctgggtagggaccgcagcacctcagagaaccctttctggggtcacttctggcaccctctgcaaacctcaagggggagcgtgaggctgggggctgtccatcagggtccaggcacctcctgaaggaacctctcaaagccagccgatcaccggctccagacccacgctgtcagacatctctgtggccaccagaccactgccactctcacgggtgtgatgacatgggacctgcctactggtagtcttctgccttcgtggaattctgcaacttccttcctgcctcggccacagcatgtcagccaagcacctgtcagggtccctccctggcaggacgatgtttagaagctcaacaccttgctcctgcctcctcttcagacccatcagaacttgctaccatgggtgtgttttaataaataacttcatttctgcagcaaataaataaataaataaatgtagttgcaatattgcctttaaaagcacttttaagcatcaattgtgaaataaaaagcccgagcaaaagccctctttgagcgtgaagtgtctaaacgtttatttgtactactattgttgtaaagggtagattttgtagcattttgaggtggtgattcaactgcattaacagcatcccgagaccgcctgccacgatctggaggaaacgcacggccagggcccacgtgcagggtagggtcctgccaggctcccaaaatgccccgtcccagcactcagtcccatggaggcagcacagcctcagggaggccagcgactctgggcctgcgggtgagtccttcagcccctgcacagcccaatccatctgccacccacttggtgaccccaaattgtagtaagtcaacacttccagttactcaacagcttctgaaatttaaatctctggaacaatttacagtaataagaccctaggtgcacctgtctactatccttgtcctccctaatgaaatgggctaggcgtggtggctcatgcctgtaatctcccattttgggaggccaaggcaggagaactgcttgagcccaggtgttgggagaccagcctgggtaacatggcgagacctcacatct

SEQ ID NO: 68033 - DNA, 469 bp, Homo sapiens
tatccctgcaaatatccataaacatacactgcaaaattttacaacaatcaaaaggatggggtatcactgttgcctattggataatcagggacatccaggggttcattttgtgatagttcagttttgttcttaggaaaagattgagtttccttagaaagacatatgaactcatttaagacatgtaaaagtggccgggcgcagtggctaacgcctgtaatcccagcattttgggatgccgaggcgggtggatcatgaggtcaggagatcgagaccatcctggccaacatggtgaaactccgtctctattgaaaatacaaaaattagccaggtgtggtggtgtgcacctgtagtcccagctgcttgagaggctgaggcaggggaatcacttgaacctgggaggcggatgttgcagtgagcggagatcactcctctgcactccagcctgtcaagagagcaagatcccatctca

SEQ ID NO: 68034 - DNA, 1431 bp, Homo sapiens
ctcccaagtagctgggattacaagcatgtgccgtcacgcccagctaatttttgtatttttagtagagatggagtttcaccatgttggtgaggcttgtcttgaactcctgacctcaagtgatcgcacctgcctcagcctcccgaagtgccgtcgtccccagccaatattatatgtgttttaacataagtatacaatgtgtatcagccatccagatcaagatatagaatgttcccatcagcctagaatgttccctcatgctctttcttggcaaaataaaacaaagcaaaataactctccatatctcactccctaaaattatcactattctgaaacttctatcactataaattggttgcttattgttgggcttttttttttttttttgagacagggtcttgctctgtcgtctggctagctagagtacagtggctggatcatggctcactgcagcctcaaccttccaggctcaaggaattctcccacctcagcctcttgaatagctgggactacagtaggtgcacgccatcacacctggctaattttagtattctttgtagagacgaggttttaccatgttgcttaggctggtcttgaactcctgagctcgagcaatctgcctgccttggcctcccaaagtgctgaggttacagatgtgagccactgtgcccagcctattctttagcttttataaatagattcataaagtatatactgtttggttttggtttctttcattcaacataatgttttttagatttatacatgatggtgagtttattcttttttattgctgtatagcatttcattgtgtaactatattatgctttatttttaccatttgttcgtgatcatttgggttgttcctagtttttggttataaatacattcttgtacatgtcttttggtagacatatacatgcatttactttgaagagcatacttaggagtataattgagtaacagatttattatatgtttaactttgatactgccaaatggttttctaatgcagttgaatgaacgtacgcttttcaccagtaacatctgagagttctacttgctctacattcccaccagcatttggtagtgtcactctttaattttagtcattttgggagagtatagtgctatctcattgtgggttttaagttgcataccccagcgagttctgttattgaacaacttcatcataggtttgttggacatttgggatcttcttttgtcaaaatgctggttcaaatttttgtctacttcacaactgagttgtcttttttattgatttgtaggagttctttatatactttggatatgaatccttcatcagatgtatatactgtgaatattttctcctagtttgtggcatcttcattcactttcttaatggtatattttaataacaaattattttaataaagcctaatttatcaatct

SEQ ID NO: 68035 - DNA, 360 bp, Homo sapiens
ctactactactaaattcgcggccgcgtcgacgcatgtttctctttaaggattattttaaaggacatctaatcacctcccacaaggtgtctccccaaacacgtgaggattacagtctggattacaattcaagatgagattgaggattacaatctggattacaattcaagatgagattatgggtggggtcacagccaaaccatatcagtggcacacacctgtagtcagtcccagctattcaggaggctgaggcaagaagttcgcttcagcatgggaggtctaggctgcagtgagccatgatcgcaccactgcactacagcctgggtgacagagcaagacccgtttcaaaaataaaaaaaaaa

SEQ ID NO: 68036 - DNA, 949 bp, Homo sapiens
gctgccttccccagtccctggtccaccctagttagcaggtctgtctaacaactgcatctcagctcttcctttcccctcagtctattccaccaattaagttggacctaggatggtattctttccctacaatggaatcaggaggaaaaataaatgcttttaatagcactgccctggatatctgattatttgcaagactagaatgctttttacaatgcagtttgatttagccacttaacttctaatcacttccatttttcagggcttggagggaaaacatgtcctttttattgctaatgtaatgatttatccatctatagcacacaggatccctaatgatctggataacttagctaacacttcatgggctcaagtatttttccagaattgctcccctattttccttgaacataggcagggagaagccaggcctgcttgggagccaagaggacagggaggagtaaccagttcaggacaaagaaccataaccctcaagcaagagaacaaggagaagaatagtgctagagtatggggtgaaatgtcagtttttaattccataggaatggacaataaaaacaaaaattttatgtttaaatggttttacctgaaattatatgactagagcatgtttctctttaaggattattttaaaggacatctaatcacctcccacaaggtgtctccccaaacacgtgaggattacagtctggattacaattcaagatgagattgaggattacaatctggattacaattcaagatgagattatgggtggggtcacagccaaaccatatcagtggcacacacctgtagtcagtcccagctattcaggaggctgaggcaagaagttcgcttcagcatgggaggtctaggctgcagtgagccatgatcgcaccactgcactacagcctgggtgacagagcaagacccgtttcaaaaataaaaaaaaaa

SEQ ID NO: 68037 - DNA, 130 bp, Homo sapiens
ttttcccccccaaagtattttcaatccacgattggttgtttctgaggttggttgactcctgggatgtgaaacccacagatagagagtgccaggcgtatatgtaatttttcaaaaaggaaaattttcaagt

SEQ ID NO: 68038 - DNA, 1073 bp, Homo sapiens
  misc_feature (26)..(26): n is a, c, g, or t
  misc_feature (58)..(58): n is a, c, g, or t
  misc_feature (780)..(780): n is a, c, g, or t
gtaaaactagggcatttagaaaatgnaaattagtatgttcactatttaaggcctatgnacagagcaaagtcttcagaaaacctagaggccaaagttcaaggttacccatctcaagtagcctagcaacatttgcaacatcccaatggccctgtccttttctttactgatggccgtgctggtgctcagctacaaatccatctgttctctaggctgtgatctgcctcagacccacagcctgggtaataggagggccttgatactcctggcacaaatgggaagaatctctcctttctcctgcctgaaggacagacatgactttggacttccccaggaggagtttgatggcaaccagttccagaagactcaagccatctctgtcctccatgagatgatccagcagaccttcaatctcttcagcacagaggactcatctgctgcttgggaacagagcctcctagaaaaattttccactgaactttaccagcaactgaataacctggaagcatgtgtgatacaggaggttgggatggaagagactcccctgatgaatgaggactccatcctggctgtgaggaaatacttccaaagaatcactctttatctaacagagaagaaatacagcccttgtgcctgggaggttgtcagagcagaaatcatgagatccctctctttttcaacaaacttgcaaaaaatattaaggaggaaggattgaaaactggttcaacatggcaatgatcctgattgactaatacattatctcacactttcatgagttcctcnatttcaaagactcacttctataaccaccacgagttgaatcaaaattttcaaatgttttcagcagtgtaaagaagcgtcgtgtatacctgtgcaggcactagtactttacagatgaccatgctgatgtctctgttcatctatttatttaaatatttatttaattatttttaagatttaaattatttttttatgtaatatcatgtgtacctttacattgtggtgaatgtaacaatatatgttcttcatatttagccaatatattaatttcctttttcattaaatttttactatac

SEQ ID NO: 68039 - DNA, 426 bp, Homo sapiens
ataaaccgtacgtacagaggaacagatgagtgcactgtggaatgggagggagagttactttcctaaagtggacttggaaagatggtaaggaaaaggctttctagcacagagctgctggagatgacacagggaagcgcttattgttttgcagaacctacacaagatctatatggttcgtgaaagatgtggatttgattttgtgaataaagtttttgatcagtagagggatataatcacaactgtgctttgaagaagcccctcctgattttaaaggcacttgtgttattatacaccccattttacagacggagtttcactcttgttgcccaggctagagtgcaatggcgcgatcttggttcgtcgcaacctccacctcccaggttctcctgcctcagcctcccaagtaggtaggattacaggcatgcg

SEQ ID NO: 68040 - DNA, 228 bp, Homo sapiens
caggtttgtaacagaaaagagaccaagctggttgggaacatggtgttctcagtgtaataagatgtattgtaagtccaaggaaaatgcatcttggtggggctgaccttattgcaccccttccccaagatttcccggagagaaacattattctggggatagtttctgttcttgtttgccaatcaataatgaattgaggttggcaaaggctgggtttttagtggaagtggg

SEQ ID NO: 68041 - DNA, 779 bp, Homo sapiens
gtgacattgtgccgaaccttgaaggtgagcaggtagggagggcgtggaggagtgtgtttggatgaaagtacgccaggagagctgtgatgtccaaaagaggtgagggaccacgaggactgagaaaagaccctaatgtgatttgtaaggcaggtgaacattgatatccatagtaagcagtgcagagggagtcagataaggggctcaggaaccatctggtggtgacaaaataatgccgcttagtgtggactggcattctgggtagtgtggtgatgaacagaagaaaacaggcaggggattcaagagaagggaaaggtgtggagaaaaagacagacacaagtgattcaagatttaagagataagggattgtcctgctttctagctataaaacctttctacactacctaaaagagatgactgcttctcccttaaggactatacccagctttttcctcaccaggctaataaatgcacttagcatttgcttaaaaatattgggattgtggccagtcgcggtggctcacgcctgtaatcccagcactttgggaggccaaggtgggtggatcacgaggtcgggagttagagaccagcctggccaatatggtgaaaccttgtttctactaaaaaatacaaaaaactagccaggtgtggtggcatgtgcctgtagtcccagctactcaggaggctgaggcaggagaattgtttgaacctgggaggtggaggttgcggtgagccaaaatcgcaccactgcactccagcctgggcaacagagcgagactccg

SEQ ID NO: 68042 - DNA, 455 bp, Homo sapiens
ctttgccctttcagttcatttggtagaggacagcttagctgggccttgaagcacttggaaggtcattctgtgcatgaatgttttttggcatttatttctgccttctatattttattttatccactgccaagggggcattttgattggcacgggagccaagtgaaacaaaacactccctccgagggacatacactaagcagctctatgagaaccacctcctttctgtcatataagggctgactttcttcctcttcactttgtttctgagagatttttgatgttttcctggccctgtcaattttattcccggcttggcttattcaccaacaccacaagacactatcagctcagacccagaaacaggatgccaacattggcagaatccatttagacatggtaacgtctagtctgaggcttacaggggactgtgactaaatttattttaaagcttaaat

SEQ ID NO: 68043 - DNA, 785 bp, Homo sapiens
cacaacctcttggcatggtgtacagtctccaacccagcatcctgaaggttacccagaaaggatccccaagttacataccttctggcgtctgtgctggctaagtgtctcagcacctctatccaaaaaccacatgacgcttgacacaggtcttctcatgggccgtatgcagcttaagccaattagatagcaggtgatccaaaccttgggtccagcttttaatccctcctatgccactggagcagctaattggctggctattgtgatagatgtcctggaagcaatactagggtctctagcctcgggtctggtccattggcagccatggactgtgttgtaaaggggcccaggtgatggagggtaccataaaaaggcgtgtttgggcaggtagggtggtcctcttggccacaccacctgtcaccactcctgcccagccctagtccccattgcaatttcaccagtcttattcttcaggcagtcccagacagcacagaccccaagattctgccctgccccaggagggcttctgggaggaggaagggccaagagaggtcttgaactgaagagccagacctggtgcagagaaggcagggtctggatgtcagtttctagcagttctacccctcacctgaacctcacactaggcctatgtactttaggcctaaaaataggcaactgggtcagacagacacccataatcccaacactggaaggccaaggtgggaggactgcttgagtccgggaatttgagactagccagagcaacatagcaagaccttgtctctact

SEQ ID NO: 68044 - DNA, 522 bp, Homo sapiens
taaattattacttatttttcatttatatttgcagtactgttatgcaggtatacacagaaagtctaggatattatttagttatataatgtgacacacttagttatatgagcccgacatttatatccacaagacatttcttagtttaaatattctcctgttaaatgttgtgggaaattatacagagatttagaatttttacagaagaaaatgtaaattatgtggtggcttactaaagggctttctcatggagtcttgggagagaaggggaggagttttacccccagtagactttaataaacatttaaaaacttttctctggtcgtgggaattatggttggtttgggtgtcttctgaacttttggtactaaacatttgccatctgtaaacacttactggacttacaatgattggagaagacacaggcatgtttgtagcaaagggaatataggacagctccaagatccggggcggcttatagtctttgcggaggaggtgagtgaatgctcagactcagtagatggc

SEQ ID NO: 68045 - DNA, 946 bp, Homo sapiens
aaaatggagggaagtgaatcctcaagacttcatgaacatttcccaaaactgaaagactcgtgttttcagataggaagcgcctactcactgaatgctaaacatgatgaattaaaataatgcacatcaaggcacagtgttatgaaattgtagaccgttaggtataaaaataaggatctggctgggcacagtggctcatgcctgtaatcccagcactttgggaggctgaggcaagaggattgcatgagtccagaagtttgaaaccagcctgggcaacatagtaaaaccctgtctctacaaaaaataaaaaaattagccaggtgcgatggtacatgcctgtaatcccagctactcaggaagctgaggtaggaggatcgcttgagtccagggaggttgaggttgcagtgagcttgtgccactgtactccagcctgagtgacagagcgagaccctgttgccaaaaaaatttttttttaaaagggatcctacatgcatccagagattaaacgaaaacaatcacctgaaaaggctctgaactcagattgatgcttctcaccagcactggaagctagatggtattggaataatacctcacagttctgaaggaaaaatatttccaagccagaattctaaacctagacaaactatcaaatataagtagaaagaagtaaacaaacacattttcagaaatgcaagatttcaaaaaatatatatctcccatgcactgttcttcagaaagccttgggagaatgtaccctaccaaaagagggagtaataaactaggaaaagttgaatttgggaaatggaatcaacttagaaagaagcaaagaggcctgtaatgataaaggggttttctaggatgacagctccatagctggaatgggggacaaccagaccagaatggagctttagtagatatattctagagcaggaaattcgagaatatataa

SEQ ID NO: 68046 - DNA, 156 bp, Homo sapiens
caaggacgcagaatgttgcatctgagaaaaacagcctaacagggctcccacactcctgtgctggagtaaacaaaacacttttcaaaacgaggtatttccaggtatttttgacaatagcgttttcacggtttaccccctaatggctcccagatacag

SEQ ID NO: 68047 - DNA, 463 bp, Homo sapiens
gccctagtacaaagatggagagctcagagcccaaaagtcatcctgtgttaaggagacatagctaagagtctcggtttgccaaggtagctggagtctacagagcagagtacaggagagaaaaaacttcagagatatagagggccatccccaagtattcagctgagtataatctgtgtttgcatatagaaaaagaccagaggatgggtaaagaaccacctgaaaggattatacgggaagcaattcccaaggcttatacagaaaacatgatagttctcatttcaaccagcttgagtaaaaaaaactcataactcatgaagcattaggtagagaatataggaaggttgtgtctcagtaatgggaggggaatttgtcttaaaatgtatgctgcaataatctcatcgagaaatgtttagaatcaagactccccaaaagatcatattgtttccaagtaacttaaccatgt

SEQ ID NO: 68048 - DNA, 468 bp, Homo sapiens
gagatgaagtctagctctgtcacccaggctggagtggagtggcacaatctctgctcactgcaacctccaccacccgggttcaagtgattctcctgcctcagcctcccaagtagctgggattacaggcacccgccaccatgcctagctaatttttgtatttctgatagagatggggtttcaccatgttggccaggcttgtctcaaactcctgacctcaggcgatctgcctgcctcggcctcccaaagtattgggattacaggcatgagccactactcccggctaaatgttagttttttatcagtaacctctcatttcttttacccaggtatgttattttgttcgttatccctaggcaagaccctctagattgcctgtaacagtttcacactcttatcaaggatgtatatattcctgcattctcttttctatagttagtcatcatttcattagaaagatatttaagaatt

SEQ ID NO: 68049 - DNA, 784 bp, Homo sapiens
gtaagtggcagctgaatttggactcagatcatctatgcagataatattaaaattaataagatatggctctgttttcaaagggcttacaatccaattagagttgaaaagtatataggtttctttatgctgtgaaacaaattaaggatcataaaatgatagttttatctagttgaggggatcaggaagggcttctgaagaaagtagcatttcagtactaagagaaaatacagggttaattttgaatctcatggtggaggtatttgaaatgcaacctaaggcatataaactttgttcaatgagcagtagagaacattgagagttaaagaaactatggcccaaagataataaatattttcaacagctagttactgtcagataggatttaaacctaaatctgaggtgagaggtggctattgtggcttttctagatgtcagttctttgtttcagttagtgaacaagacttgttgactcttccttaaaacattttaaatttattagttccatgcatttggatcacatttatgtcaatatatgtccatattccatacctgattctcatggcgtagcctgcagaccagtctccttcagtgtattccctttctaatgctctctcacttgacaaaataagaagtaccttttaatttgattattagctattcagattatagttctaaagcagtgcttttgtcatgtgacagctacagaattttagaatcttggagatataagcttttaaaaaaaattctagtgggtaaaatacatgttccttacccattcagtgca

SEQ ID NO: 68050 - DNA, 290 bp, Homo sapiens
tgcccgcctcgcctcccaaagtgctgggattacaggcatgagccaccacgcctggccaagttctttttttaaaaagccacttgcaccaaggggagagaaaaccactgaccgcatgtcaggagatgagggtcccagacagctgtaccaccaaatgaatcaggaccatggacaggtcatctgccctttgggcccctgcccactcagcagaaaacaatgaatggacaccttatgtgttgggacagggggtacagtagggaacaagcagacatggacttgccttgtggagcttg

SEQ ID NO: 68051 - DNA, 440 bp, Homo sapiens
ggatgcattcctctgtaataaaaactaggcacactgtctagtgtctgcttagaagaggactgaacccagggagtgaggaaattcttggggatgagataaaccagagactgatgctcagaggttacggtcaacctagtcctgacctgagctccctggcaagaaagagtaaccccaaggcagatcatcactactcgccaggtgcaccgagactggagctaccaccaggcttctggaagagaatatttagatttgaactctcttctattcagtgaaacataccagaactcagtctaaagctgattgtatatgtgagaccaacattagctataaagaaatagtaggccaggcacagtggttcaaccctttgggaggccaaggtgggaagatcctttgagcccaggagttcatgactagcctgggcaacatagaccctgtctcta

SEQ ID NO: 68052 - DNA, 234 bp, Homo sapiens
agctggatttcatctctgcctttataaaacagtccttttatgcagtgtgaaaactacacaacagtatgtggtatcttcagttctatagttggtacccaaattatgagcttgtggagatctattctttaaagacgtgcatgaaaatattagatgcatagaatttatggaaacatgaatccatatgttagaaaatatggggcagtgatggaatgttctactatttcattttaatcc

SEQ ID NO: 68053 - DNA, 1044 bp, Homo sapiens
  misc_feature (893)..(893): n is a, c, g, or t
  misc_feature (925)..(925): n is a, c, g, or t
  misc_feature (944)..(944): n is a, c, g, or t
cattaacaaagaggtgccgttgtgctaggataggctggagtaggaaccatgtgcccatacaaataatacagatccagatacctaaacccaagaagattatgatctagtggaagaaacggacctgaaacatggagtattaaggctctatctgacactatccacagtggagcactggggaaagttaaatgtggcaggtcccatctaacaaacaatatattgccagttgaataaatgccattcatccaggaggaaggaacagaatgatccactggccaaggacagcaatagctgtgttcttttcctggtagtgagcatcccagccagtggatcacagactggttcagttattaatgggacttaaaagctgagactattttcggcaccatacaaagaagagtgaccataagcatcttgctccctctgtgtctcccaaaccacatcagtttcatcttttgctattacagaaagttggatgggagactgccaagatgaaagcagacctttaataaatcttctgagatcagtatgaaggaggcactcaagggaagagagactagaataagtatatcctggatattatcagacttagaatggagaggaaaagtcaatatgccacatattctgaagaaatgagagatcaagcatctaacttgtattttgctagaaactcctgattacaaatattctggcccattttccccatgaaaacataatgatgtcaacatggtggtgtcaaagccagggttcccagaaaaattacttcattgagctatgatataaaaattcttcgtcagctattaggtttcaagttgatatcgctgtgacggagaatatgaaggctcgtaaccgctcggactactaaacatatgcttaactaatgcacctttgatcancgatgcacgctcgatctatattaatggtagcntgagtctcgaattgtccanagagatggtggtggaagatctcaagacgccatgcgaggggtacatgttactaggaataggtggacaacgatgcttcgcttctctagtggttgcaagccct

SEQ ID NO: 68054 - DNA, 515 bp, Homo sapiens
ttctggggtattgtgggtttggctcccttttcaaaaaccagcctgatgtggatgcttatggatgaaactgaactgctcctaccctaccctgttggcttcacaatgtataggaaaacataggtttttctccagaagaaaatctgcctgcagaatgtatctggaggttgttttccttgttgctgacatatgcactgcatgtagacaactcacataatcaactgtataagatgacccatttttttccttctcatggatctccaagtgtctgtggcttttaatagatcttttctagaggaggagtcttgatagatctttttaaggtaatctgaaaagccatcaggagaaaaattaaagcaacacatatttaagaatactttaatttttcttgttcttaattatatgctaactgtgcttaaactgcaatttctttctgttaccttttactgctgaaagtagtgattatccttgccttttagatttgaaattaattttcgtgagaacaccctgggatatca

SEQ ID NO: 68055 - DNA, 997 bp, Homo sapiens
agctgcggaagcccaggacagttcgctgggaccagtgctaatggcagcttctgctcctgacccccatcaggtctctttcctcagacatccccaaagcttgtctgcctgtgggtctttcattaaaggtgacgggcaagggttttctcttccttccaagacacacttctaggctggcttgtgggtcccctgagacgaaggctgagcagggtgagcctcgaaaaccccatagcactggcccagagcactgcggtcaatgtccgaaggaccagagagggagggtgacttgctcaaggtcacaaacctaactggagctaggaagtaggtccccagactcccagtctgaggaaattggatgtggacagggctttggtctcctggccagagcaaacgcccagggatctgaacaggctgcccatctctggcctcaactcagcaccccaactggctccagtgccaaccattggcctctctcactggttggcacaggctgggtgagcctggccctttgccctgggttcaggagagaggtatggctttgcctggcagtcaggggaggtgttccaacctgggagcccctgggggaggagcgtgtgtgtgaacgcttgtgcctgttcatcagaaggggtgagcatggtgtgtatgcgtgggcatgcagaatgcagggtgatgacctgtctgcccgccctgagtgtcacagacacctgtgtgtcccctgtactagtgcctcccagatgctcttctcctgactggctctttgtgacctaaatttcaactgctccaccccacaaggaggaaaccagggccacaaatgtagtgagattttcataaagctaaatgtattcagtggaaacgaccttcctctgatctaaaagcatgcatgcctttgttttattactggagtattaaattagcccttacttatggaataggaggacagtaggtggcaattgttttctaatgctcttacttcacaaaataaaatggtggcagcacaatg

SEQ ID NO: 68056 - DNA, 83 bp, Homo sapiens
tcatgaaccacaacataaaaccatcccttcagggaacagggctttactttctctatggctcctgggtacacttaattctcccc

SEQ ID NO: 68057 - DNA, 540 bp, Homo sapiens
gggaaatcgagaaagatgagagaatcaggaagtcatgttggcagtttacacattaaagaagacaaattaatcggacgttgtgaaagtcacaaactgacacattccaaatggtctcttatcttggcctgcagcccctttctaaaccagagaaacgggaatgccttcttccagactttggggtcacatttactgactctgcccttcagggcacggctgagaaatggtgtgtgagggactagcatgatcagaggcccccagctctaaattctgccttccccaaagacctgttggaaggcccactgccagctgttattcttacccatcaccactggggatcttccaaatgacacagagttccatagagggcctcctcatcatggacatgaagactcgctttgcaattgtattctagcaagaaggaaaaaacccatgtcagtcaccctgtggcacgagcaaattaaaaccaaagttcaacggccaggcctaggactagtggattccaaaggaaagggcgggcttcgggctattgggtggaggctc

SEQ ID NO: 68058 - DNA, 933 bp, Homo sapiens
atcatgcctggctaattttttttattttttagtagaggcaaggtttcaccatgttggccaggccaggctggtcttgaacccctgagctcaggcagtccacccacctcggcctcccaaagtgctaagattacaggtgtaagccaccacacccagctttaattcttgcatttaggtctatgattcattttatgttaacttttgtgtgtgtggcctggggtgggggttcaaattattatttttttttgagacagagtctcactctgtcacccaggctggagtgcagtggctcaatctcggctcattgcaacctctgcctcccaggttcaagttcaagcagttctccctgcctcagcctcccaagtagctgggattacaggcgcccaccaccatgcccagctaatttttgtatttttagtagagacggggttttgccatgttggccaggctgatctcgaactcctgacctcaggtgatccgcccgcatcagcctcccaaagtgctgggattacaggcgtgagccaccgtgctcggcccaaattcattcttttacatgtggatatcccattgtcccggcaccatttgttgaaaagactattctttcttcattgaatggtcttgtcgcccttatcaaaaatcagttaaccacagatgtatgtaggtgtactgccttttgaagtagttattacttaaaagttattgatacaatttctggcagtagctgttcaataatacataatagctgatcagattatttttacatcactgagagtttgtaagtgatagagctaggatttgatcccaagaatgggtgactacaaagcatgcttttatttctgtattatactgcaggctgctaaagtggatagcgtctagctgcagctgtcaaggtcagagtcaagcagctcagcatcattcacatactctgtctagctt

SEQ ID NO: 68059 - DNA, 686 bp, Homo sapiens
  misc_feature (635)..(635): n is a, c, g, or t
ggtagaagtcaaacccgacaggagacagagactaggggcccacacaccaggaggaagaacccagtgcagagagtgccagcaggaagccacaggggcagggaaggcgctcctgggagggtgggtggctgcgtcctgaggctgagcagggggagctggcctcgggacaggatgtgcgcaggcgtggagcaggaagttcctggaatgatgggcaagagggagcaggtcactgggggcaggtctaaatactgggggctgcattgggatagcagaggcctcggacaggcccgctcagcatgtagactcccctccctggccccttccctaggatgacagtggaggtccatccccaggtggtggtgagggcaatcctgacacagagaccccagcccagctggcaggggaaggggagcccccaaggacccctgtatgttggggcgtgtcccgccaggcggccctccatggtgcccagcagcagccctgcttgcggaccctctttagtccccactgttaaaaaaataattcagtgaaaattgacactagctgggcatggtggtaggtgcctataatcccagctactcgggaggctgagacgggagaatcgcttgaaccagggagtcgggaggttgcagtgagcngagatggcgccactgcactccagcctgggtgacagagtgagactccgtctc

SEQ ID NO: 68060 - DNA, 476 bp, Homo sapiens
ctttcctaggagaatgatttgtgatggagttttacccagagcaggaataggtacggctgtgagtcacaaggtggtaggactctttatttgcttttttgcccaaatgtcatggaggacacagagcagagaacctggaaaaatgtgccattgggagaacgtgatgcaccattttaggccagaatgacgcatggaagcgtaaagtaaaaaattgcggagacaccaaaatgcatctgtgtggattgttaacaaaaaagcatgaaaatgtttgatactggttgttatagggaatcattcaaaatttcttatgcgtgtattaaatctgaaatggcaaaattaaaagccactttatcaagagaaggtcctggtattttcatatcttttcaaaaactaggaattctaatacaaagtgccaattacctgacacacttatttgataagcagaggatggacgtgtccattctcagacataggcaagc

SEQ ID NO: 68061 - DNA, 471 bp, Homo sapiens
gccctgccctcatgaagagccccccggatgttcacctctgcccagagacccggcctgcccaggaagagcagtctctgctcttgtgtgggtccctctgcccccaccctgcccagggctccccagcagcctgaggcccctaaggaagaacagccctcaatggtgattctattggtgttatgagttgtgtccccaaagagatatatcagtgtcctgacccacagtacctcagaatgtgactgcatttggagatagggttcttccaggggtaaccaaggtagaatgaggtcgttagtgtgggccctaatccaatatgacggctatccttataaaaagaggaacatttaggctggatacagtggctcatgcctataatcccagcaccttgggaggctgaggcaggaggactgcttgagctcaggagttcaagaccagcctggggcaacatgtcgaaacgctgtgtctaccaaaaaa

SEQ ID NO: 68062 - DNA, 4298 bp, Homo sapiens
  misc_feature (403)..(403): n is a, c, g, or t
  misc_feature (784)..(784): n is a, c, g, or t
  misc_feature (1806)..(1806): n is a, c, g, or t
  misc_feature (2073)..(2073): n is a, c, g, or t
  misc_feature (2078)..(2078): n is a, c, g, or t
  misc_feature (2099)..(2099): n is a, c, g, or t
  misc_feature (2103)..(2103): n is a, c, g, or t
  misc_feature (2115)..(2115): n is a, c, g, or t
  misc_feature (2123)..(2123): n is a, c, g, or t
  misc_feature (2151)..(2151): n is a, c, g, or t
  misc_feature (2162)..(2162): n is a, c, g, or t
  misc_feature (2174)..(2174): n is a, c, g, or t
  misc_feature (2694)..(2694): n is a, c, g, or t
  misc_feature (2914)..(2914): n is a, c, g, or t
  misc_feature (2981)..(2981): n is a, c, g, or t
  misc_feature (3045)..(3045): n is a, c, g, or t
  misc_feature (3162)..(3162): n is a, c, g, or t
  misc_feature (3293)..(3293): n is a, c, g, or t
  misc_feature (3543)..(3543): n is a, c, g, or t
  misc_feature (3967)..(3967): n is a, c, g, or t
  misc_feature (3976)..(3976): n is a, c, g, or t
  misc_feature (4038)..(4038): n is a, c, g, or t
  misc_feature (4258)..(4258): n is a, c, g, or t
cattttacttcttcttcccttcctgcttaactatgaagaacactagagaccaacatcctaatggcagggtgtataagctcgctgaggctgagggatctgccttcttgcccctttggcaccttgcctggtggagcagtgggagagagctgctcaaataacactcactttagagactctgagagactctgccatggaggtcaggggaaatgttttggaagaaaacatccatttcagcctgtgtcactggtcactgcctttagtttcctgggttttttttgtgagactgaccgtatgaggtccttttagtatggcagatgtcctgtgttgaaaggatcttggcctaatcacgtcccttttctaaaccttggttttaccatctgcaaaaaaaataagtttgactagntggtgactggagatcttttaagctctagaagccatagattttctttcctcaggctcagaatggtagaaaatcagcattagggcatctaataggccctgtctcctacttcatacattaattccttaacaacatccataggaagagacgttggttttcatggatggtaccatatgaaaatctttttttttgagacggagtcttgctctttcacccaggctggagcacagtggcgcgatctcggctcactgcaagctccgcctcctgggttcacgccattctcctgcctcagcctcccgagtagctgggactacaggcacccgccaccacgcccggctaattttttgtatttttagtagagatggggtttcaccatgttagccnggatggtctcaatctcctgacctcgtgatccacccgcctcggcctcccaaagtgctgggattacaggcgtaagccaccatgccatttgctgttttagggaatctgttcattagcttagggcaaattaccattttaaaaatgttgttcatatgtttttcggctggaccatggcaccatgatctctattctacaccacaaataccacactgttgatgcttagccagttagactcacccagttcttatgcctacaaagtaagctaagtgtcacgtgacaaccctccccctattcgggaaaacccgttattcctaggctgataatatcccatcaatgcccatgacccagagcaatgctcaagccttttactgcagacactggcactttcttggcctagctcctgggttatcattttccacagctcccatgcccctcacaacaactggatgtattttatactctggctcagagaggacagattgtgtacggagcatggacttttgaatcatacagatgcaaaactgaatcttgccagttagtagcagtataaccttaggccatctactgcacctctctgagctttggggtttcttcctcaaataagtgaaataaggatgactctatctcaggattattgcaaatctttgtgtgggatcatctttttaagtcacacagcacaatttctagtagctagcatgggctcagtaactgctaattccctttccattgctgtccctggcgtgtttcctggtcatgctctctctccctttgtggcagctttgcccagtctgttctctctgctggtctgtcttgtccctgaagctctgtctggctatctgttccttgtgctctgaggcacagttatcttctgcaagcttatcttggtgctaattacgccttgcctgggttagacacctagcctccgtgctgcctctgaactatgtgaatatgcctctatcacagcacaaacgataccaacattggtgacaacattactaatggtcacttattgtgtacttacgacntgctaaacactgggcaagcacttcacaaacatgacttcatccaatcccacaaaaggatactccttagttactgttactcttcccatttctcagctgatgaccttgacgccggagaggttagataccacatggagaaccatgcaggcggaaaggctgagatacactcgagcccagacagcctggcttgaaggcccattctcctactgcttatctgcatcctttaatggcctttgatttcttggagggcaagggaaagaacttgctcangggcnggtacagctactaagagaccngacngagactcacgtncaagcaanttgactccagacactgcttgcttcaaanctctgctgttncttggacaatcngcttgaagaaggggcaaggatcttcccctccgttctattctatctctacatccccttaacccagtagtatggctggcgcattttgggcacccaatgaatgtttgtggaataattcctccaatctcagtccaagtctagcctgtactttttagatggggaatatatccaatactgaccactcccgattaggttcaggttagtcacggaaggagtattagttgcccaatgtctgggctgtggtgccagtatgtttctgcattatttcccatccggagaccgatcaggtttcctcctaatacacatcctcagtcttaccagtaaaggccaaacaggctcagtgctgtcctgggacactcagatcttaaagagttaggactcactttgcttgtagccttgtaggataatcataggcaaaagagatactatcatttggtcaggaacattcccatgtgctcataagagccaatattaaaataaattcatggcctgagacagggtaaagaaagaaaagtttctgggntgctctgtggatgtgtgcgcaaacccgtgtttgaaggacacgcagggccaatgccaggacattctggagtttgtgcttgacccaagataatcctaaattttgtttaatatatctgaaagcatttgtaaacagatacgagattatattttaacatgatgattattgtcataaacaatgacaaataaagaagaaaatcacaaaggtcatttatcagaaatcnaatccccccagacccttctctgcctgtaagtctacctgcctgccaggtgctgggcgctgttcttctntccttgctcctgtgtgtctgtcctcagtcccacgggcagagaaaatcccttgtttatttacacnatgcagggcctggagaagctgctttttttctgttccttttttcagttttcaatttcaatttgtgctttcctcatggcatttttctagggccactcgagaagaagaagcaaagcagcntcctttgtcttatgacaagaatggaaatacaaagggaaacaaaaagcagccccagtaggtttaccctgcaaaccagcttgacaaattaaaactaaagctggtgggagaatgcaagtcctcacgtaaaactncattttctgatctgacaatggaaaaacatgacttttctttttaatggtaaaagggactattagcctaaggccctgtcatattatccccatctacaatgaaccttattttgaaaagtgttctattatttcaagctcagatggaattcaatcaaagaaaaaacatttctgtttatcagctttattatcactttgggttcctaaacccaagtaatctctctctcttccttgagccaatatggacatagaaacntacatacattctatcactgaatagttgagtttattctcattattattatgcccattgcacaagtcatagttgctaactactccagggtcaaaactctgcataaaaattataggctacgattttcagactattaacttttttttagaatgactgtttaggagtgacagcttttctcccaagaggagtaattctttcctctctgtttctcttaagattgtttttactgttgcatgtcacatgtaaaaaattaagtggacctctctgactacttgtgaggaagtttcaagaagagtaattatcagtataattgtcattatcagtagttaataccactaatggtatatggttctccagcaaattcttttgtctcctcctttacattaaatccacaatttagccacttctcaccattccaggtctgggntactatccnctctcctaggttaccgctatagccccattaagaagtttccttgtggctgggctggctcacanctgtaatcccagcacttcgggaggccgaggagggtagatcacctgaggtcaggagttcgagaccagcctagccaacatggtgaaaccccgactctactaaaaatacaaaaattagccaggtgtggtggcatcagcttgtagtcccagctactcaggaggctggggcaggaggatcacttgaacccgggagacggaggttgcagtgagctgagatcgcatnaccgcactccagcttgggtgacagagcgagactctgtctc

SEQ ID NO: 68063 - DNA, 510 bp, Homo sapiens
ttgcccggagaattgaagtaatttgcacatgaatcagaaaatgaagctagtgtcctattcaggtaaaaatgtgttaagcaatacaaaataggaaacaacaggtggttctttatttcaagttaatatgacctgatatagggttttccctgtttagctttttatatttgtttcttttcatttttgttttccctagctttcatgaatttttttgtttccatctcctggtggacctttttgaaagtagagttaatttcctttttcttttctgatattttatagtaatatagaattaaataatatgttttgtaccctggtgactcagagttttaaaatctgggattatggagcaatataattcaggggcctatacgtgtagatgggaaagggttacatctttagttccattaacctgtaaatgaaagatagcatttatgaccgaacgcagtggctcacaccagtaatcccagcactctgaaaggcagaggtgggcagatcacttgaggccaggag

SEQ ID NO: 68064 - DNA, 738 bp, Homo sapiens
ggctcccccaccagtcgcgtctggggtgtcttattttttgtgtctattctctgggcggtctcgccctgtgtgtgacgtcccctctgtctgtttaggttgtttcccccccccttctttttgcgcgtctctcctgtgtctgcccgctccttttgtggatgattttttgtccgacagcaaccgccgtccccggtgtggttcctcccccccggggcgtctttgttgttatttgtgttggtgatatttctctcctcccctctctttttctcttgtcgccccgggggttgttcctgttttggggtccccggctttttgtgcccacaagtgtccagtgtggccgatttgtggggcccccgcgccgccgcaacacgatgttgttttatagaaagcgtttcttcgaggggcccctgaccgcgcccgcaccaagattgttttttgttttgtttttttttttttttttttgcttttccaactttatttagaaaaacaaatccaggtcccagtgccccctgtaccctccccgaccccagccataatttaaataacttagagacagagttggagggaggggacaggagaggttggggtcacggtggaaggaggaagagagcccactacagccgccgcagcgcccccttctgtcgtctttttcttggccgccagcttcttatcgcgctcgccagcatgcttcttggccatgggacctggatttgtttttctaaataaagttggaaaagcaga

SEQ ID NO: 68065 - DNA, 785 bp, Homo sapiens
ggctcccccaccagtcgcgtctggggtgtcttattttttgtgtctattctctgggcggtctcgccctgtgtgtgacgtcccctctgtctgtttaggttgtttcccccccccttctttttgcgcgtctctcctgtgtctgcccgctccttttgtggatgattttttgtccgacagcaaccgccgtccccggtgtggttcctcccccccggggcgtctttgttgttatttgtgttggtgatatttctctcctcccctctctttttctcttgtcgccccgggggttgttcctgttttggggtccccggctttttgtgcccacaagtgtccagtgtggccgatttgtggggcccccgcgccgccgcaacacgatgttgttttatagaaagcgtttcttcgaggggcccctgaccgcgcccgcaccaagattgttttttgttttgtttttttttttttttttttgcttttccaactttatttagaaaaacaaatccaggtcccagtgccccctgtaccctccccgaccccagccataatttaaataacttagagacagagttggagggaggggacaggagaggttggggtcacggtggaaggaggaagagagcccactacagccgccgcagcgcccccttctgtcgttttccaactttatttagaaaaacaaatccaggtcccagtgccccctgtaccctccccgaccccagccataatttaaataacttagagacagagttggagggaggggacaggagaggttggggtcacggtggaaggaggaagag

SEQ ID NO: 68066 - DNA, 756 bp, Homo sapiens
  misc_feature (693)..(693): n is a, c, g, or t
  misc_feature (696)..(696): n is a, c, g, or t
ggctcccccaccagtcgcgtctggggtgtcttattttttgtgtctattctctgggcggtctcgccctgtgtgtgacgtcccctctgtctgtttaggttgtttcccccccccttctttttgcgcgtctctcctgtgtctgcccgctccttttgtggatgattttttgtccgacagcaaccgccgtccccggtgtggttcctcccccccggggcgtctttgttgttatttgtgttggtgatatttctctcctcccctctctttttctcttgtcgccccgggggttgttcctgttttggggtccccggctttttgtgcccacaagtgtccagtgtggccgatttgtggggcccccgcgccgccgcaacacgatgttgttttatagaaagcgtttcttcgaggggcccctgaccgcgcccgcaccaagattgttttttgttttgtttttttttttttttttttgcttttccaactttatttagaaaaacaaatccaggtcccagtgccccctgtaccctccccgaccccagccataatttaaataacttagagacagagttggagggaggggacaggagaggttggggtctggggtgggggtggcaaactgggagtggccggcaggggtgcagggggtgaaacaggaggcccagggaccggtggaggcgggggttcctttggggggaaaggcactancancgggtcgggccccgggggctgtttttggctccgctccaggcccgacactttagggaccac

SEQ ID NO: 68067 - DNA, 727 bp, Homo sapiens
ggctcccccaccagtcgcgtctggggtgtcttattttttgtgtctattctctgggcggtctcgccctgtgtgtgacgtcccctctgtctgtttaggttgtttcccccccccttctttttgcgcgtctctcctgtgtctgcccgctccttttgtggatgattttttgtccgacagcaaccgccgtccccggtgtggttcctcccccccggggcgtctttgttgttatttgtgttggtgatatttctctcctcccctctctttttctcttgtcgccccgggggttgttcctgttttggggtccccggctttttgtgcccacaagtgtccagtgtggccgatttgtggggcccccgcgccgccgcaacacgatgttgttttatagaaagcgtttcttcgaggggcccctgaccgcgcccgcaccaagattgttttttgttttgtttttttttttttttttttgcttttccaactttatttagaaaaacaaatccaggtcccagtgccccctgtaccctccccgaccccagccataatttaaataacttagagacagagttggagggaggggacaggagaggttggggtcctgggaaaggggaaagatagaccctttagacagtcctgactttcggttttggaacacttcttgtggtcggccaatttagattggaccagtgagggtttgatttggtcttgaggcgccatagcccttgggggggcggcggag

SEQ ID NO: 68068 - DNA, 980 bp, Homo sapiens
ggctcccccaccagtcgcgtctggggtgtcttattttttgtgtctattctctgggcggtctcgccctgtgtgtgacgtcccctctgtctgtttaggttgtttcccccccccttctttttgcgcgtctctcctgtgtctgcccgctccttttgtggatgattttttgtccgacagcaaccgccgtccccggtgtggttcctcccccccggggcgtctttgttgttatttgtgttggtgatatttctctcctcccctctctttttctcttgtcgccccgggggttgttcctgttttggggtccccggctttttgtgcccacaagtgtccagtgtggccgatttgtggggcccccgcgccgccgcaacacgatgttgttttatagaaagcgtttcttcgaggggcccctgaccgcgcccgcaccaagattgttttttgttttgtttttttttttttttttttgcttttccaactttatttagaaaaacaaatccaggtcccagtgccccctgtaccctccccgaccccagccataatttaaataacttagagacagagttggagggaggggacaggagaggttggggtcacggtggaaggaggaagagagcccactacagccgccgcagcgcccccttctgtcgtctttttcttggccgccagcttcttatcgcgctcgccagcatgcttcttggccatgggaccctcagcccctcccaggccccctggggccccagggtcggtggaggaagctgcagtgccactggccagggcccgcccggcttcggccctgccgctggggcagtttctccacgttggagttcatggctgcggccggccgggggcgggtccccccggcccccttcctgcgttcttcggtccgccggccggggcgggggcccaactgctgccgctgcggccctggagaggccccggcggccccgctccgctccccgctgcctctgacgtccgccgcgcacagc

SEQ ID NO: 68069 - DNA, 674 bp, Homo sapiens
  misc_feature (645)..(646): n is a, c, g, or t
  misc_feature (651)..(651): n is a, c, g, or t
  misc_feature (654)..(655): n is a, c, g, or t
  misc_feature (657)..(657): n is a, c, g, or t
ggctcccccaccagtcgcgtctggggtgtcttattttttgtgtctattctctgggcggtctcgccctgtgtgtgacgtcccctctgtctgtttaggttgtttcccccccccttctttttgcgcgtctctcctgtgtctgcccgctccttttgtggatgattttttgtccgacagcaaccgccgtccccggtgtggttcctcccccccggggcgtctttgttgttatttgtgttggtgatatttctctcctcccctctctttttctcttgtcgccccgggggttgttcctgttttggggtccccggctttttgtgcccacaagtgtccagtgtggccgatttgtggggcccccgcgccgccgcaacacgatgttgttttatagaaagcgtttcttcgaggggcccctgaccgcgcccgcaccaagattgttttttgttttgtttttttttttttttttttgcttttccaactttatttagaaaaacaaatccaggtcccagtgccccctgtaccctccccgaccccagccataatttaaataacttagagacagagttggagggaggggacaggagaggttggggtcacggtggaaggaggaagagagcccactacagccgccgcagcgcccccttctgtctcgcnnccgcntannantagtagtaggcggccgc

SEQ ID NO: 68070 - DNA, 1905 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68071 - DNA, 463 bp, Homo sapiens
tcttggctcagggcctgggttgagggagcttagggaaggacgtccgtctgggtgcttttcctccagtttgctggctggcttctccgtctacccgcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68072 - DNA, 2485 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatgaaaaaaaaaaaaaaaacaaaaaaaaacaaaaaacaacaaaacttaaacataaacacaaaaaggggggggccctcttatagaagatactcccgcggaggggcgcccaatttgtgcgtgttctccccgagtttttgtgacacacagggtgcccccaaattatagagcggcgcgttatataataaccgcggagccgtgggcgcacccgcgcctgttttacacaacgctgcgtgctgttgacagctcgcgcacacactgtgtccacctctgggggatacattttatgtggacggagacacactctctcatctcaggggggggggggacccaacatggggggcaaaacatctctccccctcagagacagacatatgtaaaaagcggcccccttgaggggggaacaaacttactacaacaacttttactcaagagcgggtgctattacgagtgggggtgcgaaccacacctgccgccgtgcgatatttagtggtgccgccgccgcggcgttcagaaaaaactttttgcacctcccaccggggaagatcttgatattttgcgcacacaaacttttttatcacccgggg

SEQ ID NO: 68073 - DNA, 2007 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttaggtaggagatgaggggctgggcaggaggatgggagggggatctggcctgcccagggagatggaggccccctccttcgggccccaaactccctctgcttctgcattggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68074 - DNA, 1851 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttgcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68075 - DNA, 1614 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68076 - DNA, 1451 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagcgtagtggaagagtcagcatacgg

SEQ ID NO: 68077 - DNA, 1770 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68078 - DNA, 1818 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68079 - DNA, 1920 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggacatgagcgccgaagggagcgtgtgcagtgcgtagtgaaaaggcgcaggaacctgacgcgactgccccactggcgatccctgctgctactcctctgtgtgggcctgtgtcccactcgtctccctgtatcgagcatgacggatgctttcaggcaatcgttgcgtgcgcccatgcgatttggcgcgcaggtctgggtgctcgcatgtggacagctacgcgctgtgttgctgagcctgcattgtcgtgcctgtgcgcctggtatggcttgatggccgcctgcttgcgagcgcgcttgggacgagccactggcatctccagagcaggcccggggcagcaagggaggcgccgcgatgccagacgaaaatatcttcctgttcgtgcccaacctcatcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68080 - DNA, 1718 bp, Homo sapiens
  misc_feature (297)..(297): n is a, c, g, or t
  misc_feature (321)..(321): n is a, c, g, or t
tctgtagtacctatcatctcggggccagtcttctccctaacggctttgttgttcacagtgggcgccatgttgagtcgtactgagttcataggcgcatgtgcggtgcgttcgatgcgctggtgcgtgggctgagtgctcgcttgggatctggtgatcaagatggtatcttctgatgctgtccggtgcttggaagggagtagctgacggatgagtgagacggactctatcttcctgtttcgtgctccaaacgtcgtcgtgttgtgctccggcattgtctttcgtactgtctatttcgtnttcgtacatgtctatgcctcttgnttgagctcctgtctacggtgcatccatcctttcttacctggtcctaggtcatagcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68081 - DNA, 1648 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68082 - DNA, 1109 bp, Homo sapiens
ctggtacggtcggaggtttgggatgcagtcactggctgcacctccacagttctgtggtccgaggcagtgagagtcacaagatgatcgacttgtccgggaatccggtgcttcggatctactacacctcgaggttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68083 - DNA, 925 bp, Homo sapiens
cctctctccccgtccgccccttccgcgccctccccaccctcccccaccaccacctccccccctatcgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68084 - DNA, 1023 bp, Homo sapiens
ggatggtgattgtaaagaggatggagagtattagaggatgtcgtggttgtaagaggaggtgtagttcaacagaatgcctgcttttatgtggatgggggttgtcaaaggagtcataattgtaacagtcagttgtgtgccattcaccttgagcgtgtaccggtcgttgatgagaatctgctcttcgttaatgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68085 - DNA, 861 bp, Homo sapiens
tgccccgtttacgcggagaacgtgacgtacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68086 - DNA, 1102 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttcccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68087 - DNA, 541 bp, Homo sapiens
tataatggtggaaatattccaaaattccatattttgggatttatacacaaaagataaacaaattagaggccaagaggctgccggaagggaaaaacggggcctggaaaggccgttgtgaggaatgagcttggcctaaagaggccactggcaggcagtagctggacctgccgaagtggccgaaaggcaggagctttggacgggggaggccgcagtgaggcgagagctagctgggcgtggagagtccactgtgaggccaaggccaaggccggcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68088 - DNA, 1444 bp, Homo sapiens
tatcggctcactgcaacctctgcctgctgggttcaagcgattcttgtgcctcagcctcctgagtggctgggactaccggcacgtgccaccacactcggctaatttttgtattgttagtagagaggggtttcgccacgttggccaggctggtcccaaactcctgacctcaggtgatccgcctgtctcagcctcccaaagtgctgggactccaggcatgagccacacgcctggctgagaccaggagttttgaggctgcagtgctatgatcatactactgcattccaacctggatgagagagcgagaccctgtctgtaaaaaagaaaaaaaaataagagaagtaatatgccgagattgtgccttcattagtgctgggggggcagggggtggcacacgcctgcctcttgctaacgtggcctgtttgctgtgtgtgcagcctgctctgttcaccttgtgtgctgggaatgagctcttcccctccttcgggccccaaactccctctgcttctgcaccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68089 - DNA, 882 bp, Homo sapiens
  misc_feature (870)..(870): n is a, c, g, or t
  misc_feature (882)..(882): n is a, c, g, or t
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggctttgaaggccctggttcttgttcnaccctttggggn

SEQ ID NO: 68090 - DNA, 1716 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacgcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68091 - DNA, 1896 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggggagaggttgcagtgatccataatggtgccactccagcctgggaggcagagccaggcagtctcaaaaaaaaaaaaagcaactttggcccgtcttggaggctcacgcctggcctgtaatcccagcactttgggaggctgaggtgggaagatcacttgagtccaggagttcaagaccagcctgggtcacatggcaggaccccgtctctaca

SEQ ID NO: 68092 - DNA, 1823 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68093 - DNA, 1999 bp, Homo sapiens
ggcggagggaggaaaagggaaaggaagccgacaggccttaaaggggccgcaactatttttttaagccactttttcctctctccaattttgcaacgacgggcgcggaggaggaggttcccggaagccacgcgcagctggagcagcggcgaccgcagctggaggcccggagcgcctgcggggctggcagaggcgagggaggttgcgggtaggaagggcggactgcgcgcgccccctgcgtcccgcgcacctcggggccggtccatgctcccgacggctgcgggcttcagcatctggggccaggttggggcggcggggtccagggcgcaggtggtgcggccgatgcgccgggccggaggctgaggccgcgctgcggggctgggacagcactggcatctccagagcaggcccggggcagcaagggaggcgccgcgatgccagacgaaaatatcttcctgttcgtgcccaacctcatcggtgagtgctgcccacggccccgggccgaacgagagggcgaggggccttggcgggctccctgatcctgccctgtctccccgcgtcccgttccaaggttatgcccggattgtcttcgccatcatttctttctacttcatgccctgctgccccctcacggcctcctccttctacctgctcagcggcctgctggacgctttcgatggacacgctgctcgcgctcttaatcaaggaacccggtttggggccatgctggacatgctgacggaccgctgctccaccatgtgcctgttggtcaacctggccctgctgtaccctggagccacgctgttcttccaaatcagcatgagtttggatgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68094 - DNA, 1454 bp, Homo sapiens
gaaagaccccaggcaaacctgcctctctttaaagcttcagtcatgtttacagttgcattaagcaattcttaggactcttctggctgggtattctaggattccatataggtgacagcttataggaaggggcatgggagctttcaaatgtggcatttgaatcctgactctgcccccaaataggtaactgtggctttcggcaggatactggtccttagccgtgcccagttttccatctgtacaataggtgttaacatgaggattggatgcatggtagtggtcatgccttgtgggttcccctgttttctccccaagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68095 - DNA, 1206 bp, Homo sapiens
ccaagcaccggattcccggacaagtcgatcatcttgtggccagtcactggctgcacctccacagttctgtggtccgaggcagtgagagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68096 - DNA, 1146 bp, Homo sapiens
attcggcaacagaggtgaaaggcgggagtcacaagatgatcgacttgtccgggaatccggtgcttcggatctactacacctcgaggcctgctctgttcaccttgtgtgctgggaatgagctcttctactgcctcctctacctgttccatttctctgagggacctttagttggctctgtgggactgttccggatgggcctctgggtcactgcccccatcgccttgctgaagtcgctcatcagcgtcatccacctgatcacggccgcccgcaacatggctgccctggacgcagcagaccgcgccaagaagaagtgacgctggagccccgggtcctggctgcccacctgccctgggagtcttgctgtgccacacagctccccaccccctgctaggaggtcccagtctcacgccttcctcatgtgttgttctacctgctgggatgggggtcagcctctctttggtgacgtcacgttctctgggatcctgaggacccgggcctcaaatcagggaggatacgcgggaggccccctccatccaggcggtgctcctggggtgccgggaccgggcagtgtcacaccctgcctgctcagtcctggggtccgagatgctagggacgcttgagtgagggaggtggtgtgagggccaggtttcctgaaaggcgggagtcagacctccgcccccagccagagcaagcttggggcaccatgcccaggagggaagaagccatccacagccttccctgtcaccggctcctctgtcctgcctaccctggtcctggcgggacttcactatttgacttggtttcctttcagatattcttggctcagggcctgggttgagggagcttagggaaggacgtccgtctgggtgcttttcctccagtttgctggctggcttctccgtctacccacagtgacctcacagagaggccctcctgccacccatgctcatgtggtgtccccaccgcccacttgtttgatgtcactgactgtctacatgtatttatattcttgatattttctaccctcactagaatgtaaactccatgaaggcacagacttttcttgttctcttctctatccctagagtaagaccaacttgaacctggcatatagtagctgcttaataaatactcgtctgtcaatga

SEQ ID NO: 68097 - DNA, 950 bp, Homo sapiens
ggtttccttcttgatccttcacaagggaagattttcttttttagaggtacagattcctcttagtcaagtcctgattaaaactccagctaagacattagtaagccttggttagtgaagtggcatcaggaagtgcctacattttcatggcctggtagcgttcagtgaaaatgttcattaacagacacaggccattcagtcccgaatcccaagacactgaagactctgtttgaatcagactcacgggttccttcctagccactctcagggacaggaatgcttctggtgaagaagttttcggtggtggttcatggagcttccctacaccaacttggaaatggcattcattttattggcttttgttatcttttccttatttaccctggcttccatctacactactccggatgacagtaatgaagaggaagaacatgaaaaaaagggaagggaaaagaaaaggaaaaagtctgaaaagaagaaaaattgctcagaggaagagcacagaattgaagctgttgagctatgatctcatagccaccgatatttctcgctaagaagacagaggaagcaatccatgggaactacttatccacagttaaacaagaggaggggataatgaagaaagttaaaatcacttactgattaaacacgatgataataacctttaatgaactcaatactcgggaaaggcttcacatttctgggactcagcattatccaaaatatctattaagagccatacaccattctagctgcaattgattatacaaaaaaaaaagaccaaagtggttacaataataaaatagaacacagagaaagaagaaaactacatgtgttacaatttggtaagataaacaaacaaacaaaaaatttaatcactttttttggtcctgtgacacacatgataatttttgtcttaattctcctaacaaatgataatgaaaagctataag

SEQ ID NO: 68098 - DNA, 1068 bp, Homo sapiens
ggtttccttcttgatccttcacaagggaagattttcttttttagaggtacagattcctcttagtcaagtcctgattaaaactccagctaagacattagtaagccttggttagtgaagtggcatcaggaagtgcctacattttcatggcctggtagcgttcagtgaaaatgttcattaacagacacaggccattcagtcccgaatcccaagacactgaagactctgtttgaatcagactcacgggttccttcctagccactctcagggacaggaatgcttctggtgaagaagttttcggtggtggttcatggagcttccctacaccaacttggaaatggcattcattttattggcttttgttatcttttccttatttaccctggcttccatctacactactccggatgacagtaatgaagagtctcactctgtcagccaggctggaatgcagtggcgtgatcttggctcactgaaacatcggtctcccaggttcaagcgattctcctgcctcagcctcctgagtggctggaactacagaggaagaacatgaaaaaaagggaagggaaaagaaaaggaaaaagtctgaaaagaagaaaaattgctcagaggaagagcacagaattgaagctgttgagctatgatctcatagccaccgatatttctcgctaagaagacagaggaagcaatccatgggaactacttatccacagttaaacaagaggaggggataatgaagaaagttaaaatcacttactgattaaacacgatgataataacctttaatgaactcaatactcgggaaaggcttcacatttctgggactcagcattatccaaaatatctattaagagccatacaccattctagctgcaattgattatacaaaaaaaaaagaccaaagtggttacaataataaaatagaacacagagaaagaagaaaactacatgtgttacaatttggtaagataaacaaacaaacaaaaaatttaatcactttttttggtcctgtgacacacatgataatttttgtcttaattctcctaacaaatgataatgaaaagctataag

SEQ ID NO: 68099 - DNA, 915 bp, Homo sapiens
accccagtatataattgaagacactagtaacacctgactgcatctcatctcagcagagccagaatatggggacaaggttcagggtgccctgctgaatggtgtgaacagcaggatctcaaggatgtaatggaaagaactaccacactgaccatccagaatctaagagaccatctgggtgtttgggaaaccatctgacgaggcctgactctattccagttagattgacaataattgagcagcaggcatttttcatttctggtcaggaaagcattgtgcctttagcaaacaatcagtgtgcaacagtgatgtggtcatctagccagggaatggctgctccatcccctgcataatatattcctgcttcaaacacctctcagaaaaccagttccgcgagggtttttatatccccacaaagttgttgagagacaatgatgaccctggaagtggggaggaggacttctgagaaacagcaacctctctcctgattggggtagccatgagatttctctagctatatccaacttggcatctgtacatcatctttggaggaacatcttatttgtggaaggaccttgacaagccgtttgagatggaatgtaggccctgatgttatgcttcagtaaaaaaagatggaagcttccctgctataccaaaacatggagcaaaatttgcatttttctcaagaaggagagaaaaggagtaggactccagcaaagtttgtcagaaggaaagctagaaaagatttaaaagaaaaaaagaaagaacaaatcagcagtggtggtatggatgaaagggacttgagagaacaaaaatggctaagggaaaattttaagtcatctgctgagcagtgtgctgtgtcaacctcctcctaggtctcctctatgaaatatttagtaaagtctacatttctcttta

SEQ ID NO: 68100 - DNA, 371 bp, Homo sapiens
gtcatgagtctgagaccagcctggccatcatggcaaaaccctatctctactaaaaatacaaaagttagctgggtgtggtggcgtgcacctgcattctcagcgacttgggatgctgaggcagaagaatcgcttaaacctgggaggcagaggttgcagtgagccgagatcgctccactgcactccagtctgggtgacagagtgagaccctgtctccaaaataaaagaaatttactgcaaagggatgttgcatttcaggtgaatgtatgtagccttcagaggccgggctatttattagatgtattttataactgaggattctaggtaaacacaagccaaacagatccaccagaagcctagagctgtgaactctt

SEQ ID NO: 68101 - DNA, 817 bp, Homo sapiens
ttttttgagacggattctcgctctgtcacccaggctggagtgcagtggcacaatctcggctcactgcaacctccgctcccaagttcaagcgattctcctgccccagcctcccaagtagctgggattacaggcacctgacaccatgcctggctaatttttgtatttttagtagagacagggtttcaccatgttggccaggctggtctcgagctcctgacttcaggtgatccgcccgccttggcctcccaaagtgctgggattacaggcatgagccaccatgcctggccctcatcattctatttctccttctactattttatgtgacatatcacacaacccagtgcatggtttacacaggtattattattattctcgagattcagagatgcagaaagatccaaaaacagcccaaggtcactgagccattgctgacaggccaggggctgaggtggcctttcctgacagcccaggatttcccttaagccactgacctccaaaagcacctcctctcacagccgtaaggccccacctggtctaacctgctctccccgccacctgtggcatagtttcctctcagatccctctcctcatcttccttcctccctcagcacgggccagccccttattctaatgttagggtttatctcacttgacctcttgtcccttgcgtgcccttctttatgcaaacccaagaggagtaaatcccctgcatgctggggagtaattactcctatcacagaagtctttcccatgagcacccctcttgggtcacctgtctcattccactctgcattagggtatttgcgtgtccgtcgaa

SEQ ID NO: 68102 - DNA, 488 bp, Homo sapiens
tatccatgagcatggaatgctcttccatttgcttgtgtcctctcatatttccttgagcagtggtatgtagttgtccttgaagaggtccttcacatcccttgttaagttggattcctaggtattttattctctttgaagcaattgtgaacgggagttcactcatgatttggctctctgtttgtctgttattggtgtataagactgctaaaacaattaggagatatacctaatgctaaatgacgagttaatgggtgcagcacaccagcattgcacaggtatacatatgtaactaaccggtacattgtgcacatgtgccctaaaacttaaagtataataataaaaaaaagcattcctgctggttaacaaaccatggagggaaggacaaagcagagagggcttggcaatacaccctgctaggaaagaactcttctctatgagatggtaaagtacttttaggcccactcttcagaatgcacagtgctgagtgt

SEQ ID NO: 68103 - DNA, 551 bp, Homo sapiens
  misc_feature (551)..(551): n is a, c, g, or t
agcatttttagcgtacaacaacatccaagtggattactatgaatgcctagacctctatggcaaacagtctcttcgtggcctgtgctgaggactacatcagtctcctgcaattatcatctacactgaaaaacaaagaggacagaggcaaagctagtggccctcaccatcccctgcaagctgattgcttcttactgcaagcacttgagcatcttcctgagagctttcttgggcaatgggaaccaggcttggcccaatcacaggcaggtgaaaagtatgaggaaatggagaaggcattgtccaaggagcagtcttcaaccttcaccccgcaagtgagacaactctgaataagatgtgttctacactctcttccaaaggtccccagttggatggagctctagctgctcatgtgataagctgcctattaatacacaaaagattgcctttcctccttgctctgtcttcctgctgctctcctactaatgtttcctgggattgcctccaaataaaccactggcctcgttggcctcagcggtggagctctgcgcgcggan

SEQ ID NO: 68104 - DNA, 535 bp, Homo sapiens
agcatttttagcgtacaacaacatccaagtggattactatgaatgcctagacctctatggcaaacagtctcttcgtggcctgtgctgaggactacatcagtctcctgcaattatcatctacactgaaaaacaaagaggacagaggcaaagctagtggccctcaccatcccctgcaagctgattgcttcttactgcaagcacttgagcatcttcctgagagctttcttgggcaatgggaaccaggcttggcccaatcacaggcaggtgaaaagtatgaggaaatggagaaggcattgtccaaggagcagtcttcaaccttcaccccgcaagtgagacaactctgaataagatgtgttctacactctcttccaaaggtccccagttggatggagctctagctgctcatgtgataagctgcctattaatacacaaaagattgcctttcctccttgctctgtcttcctgctgctctcctactaatgtttcctgggattgcctccaaataaaccacttgaactcacaaaatagtgttatt

SEQ ID NO: 68105 - DNA, 603 bp, Homo sapiens
  misc_feature (603)..(603): n is a, c, g, or t
atcaactttcatagaaggaaggaaagaagaaagggaggaagaaaggaaaacagggagcctagagaaaggagggagaaaataagaaaaaaaaaagagagagagaaaggtagaacctggattctcttcgtggcctgtgctgaggactacatcagtctcctgcaattatcatctacactgaaaaacaaagaggacagaggcaaagctagtggccctcaccatcccctgcaagctgattgcttcttactgcaagcacttgagcatcttcctgagagctttcttgggcaatgggaaccaggcttggcccaatcacaggcaggtgaaaagtatgaggaaatggagaaggcattgtccaaggagcagtcttcaaccttcaccccgcaagtgagacaactctgaataagatgtgttctacactctcttccaaaggtccccagttggatggagctctagctgctcatgtgataagctgcctattaatacacaaaagattgcctttcctccttgctctgtcttcctgctgctctcctactaatgtttcctgggattgcctccaaataaaccactggcctcgttggcctcagcggtggagctctgcgcgcggan

SEQ ID NO: 68106 - DNA, 851 bp, Homo sapiens
atcaactttcatagaaggaaggaaagaagaaagggaggaagaaaggaaaacagggagcctagagaaaggagggagaaaataagaaaaaaaaaagagagagagaaaggtagaacctggattctcttcgtggcctgtgctgaggactacatcagtctcctgcaattatcatctacactgaaaaacaaagaggacagaggcaaagctagtggccctcaccatcccctgcaagctgattgcttcttactgcaagcacttgagcatcttcctgagagctttcttgggcaatgggaaccaggcttggcccaatcacaggcaggtgaaaagtatgaggaaatggagaaggcattgtccaaggagcagtcttcaaccttcaccccgcaaacggaatctcactctgtctcccaggctggagtgcagtggtgcgatctcggctcaccgcaatctccgcctctcgggttcacgccattctcctgcctcaacctccagagcagctgggactacaggttcctgccaccacgcccggctaattctttgtatttttagtagagacggggtttcaccgtgttagccaggatggtctagatctcctgacctcgttatttgcctgcctgggcctcccaaaatgctgggattacaggcgtaagccatcacacccagccggcacagtgcttttaagcatatggttgatccatatggtggcagtgtcattacttaatttttttaatagttgaataatattccattgtgtggatatataacatttaaaaaatcaatttataaattgatggacatttggattatttccactttttggctattgtaaataatggtgcaataaacatttatgtaca

SEQ ID NO: 68107 - DNA, 326 bp, Homo sapiens
ctattttagtattcataaataagttatgtcagaacatagcctgctcactcatttgcatattgtctctggctgctttcttgctaccgtggcgaagtttgctgtctgtcctgcaaaatctaaaatatgtgctttctgttcctttacaggaaaagtttggcaccccctggtttaacaggacacatttgagggtgaatgagggtactattaataataagttaggacaacaggcataagctgagaatatattgggcaagccagtaggtttgatcaccctccatatattatgcacaagaagaaataaacatattagaatggaaagtggtaaa

SEQ ID NO: 68108 - DNA, 732 bp, Homo sapiens
  misc_feature (26)..(26): n is a, c, g, or t
aataggctaggtacgaggctgggtgngtacagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaa

SEQ ID NO: 68109 - DNA, 894 bp, Homo sapiens
accccatcccccactcctataccggtcctccattttggtgcctgcaaagctctgggaaagaatcccgggaaacgaaaaatggtgggtttgggggaagggaggtaaggggagaaagctggagggaggggctttaattggaggccccgtagaggacgcgcggaacttctaaggtgggaaaaaacgaaattaaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaa

SEQ ID NO: 68110 - DNA, 886 bp, Homo sapiens
  misc_feature (26)..(26): n is a, c, g, or t
aataggctaggtacgaggctgggtgngtacagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaaaaaaaaaaaaaaaaaaaaaaaaaacaaaagggggggttatatgggcggggggggaaaaaggggttgaaaggggcatgggaatgggtccgggacccgttttttggccaagggggaaaggggggcccaaaggggggaaaatggaaaccggtacgac

SEQ ID NO: 68111 - DNA, 921 bp, Homo sapiens
tgacaggctgtgcgctctggggcacctcatgcagacgggagtagggaggctgttttttgcgcgtgcatatgcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaa

SEQ ID NO: 68112 - DNA, 765 bp, Homo sapiens
ctagcctcccgcctctcatccacctgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaa

SEQ ID NO: 68113 - DNA, 942 bp, Homo sapiens
tcatcgctgtctggaacagcagatgactcgagagcgggcgtgcatatgcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggccaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaa

SEQ ID NO: 68114 - DNA, 760 bp, Homo sapiens
atcgagctcgtaccctgatggactgaagactgcagagtgggaaaaaacgaaattaaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaa

SEQ ID NO: 68115 - DNA, 786 bp, Homo sapiens
gaaacgcgcacaccgccgccacggcaaagtcacgggcgtcactacggctagtagagccccgtggttatcggcgaggcggcagccttcggtgcagtcgtcactcgcgtctggctaccagctccccgctgccctgagctcggcgggctggcattcggcccggggaaaagcggagcagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaa

SEQ ID NO: 68116 - DNA, 970 bp, Homo sapiens
tgacaggctgtgcgctctggggcacctcatgcagacgggagtagggaggctgttttttgcgcgtgcatatgcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaaaaaaaaaaaacacagcacccagaacaaacaacaaacaaacacagggaca

SEQ ID NO: 68117 - DNA, 973 bp, Homo sapiens
tgacaggctgtgcgctctggggcacctcatgcagacgggagtagggaggctgttttttgcgcgtgcatatgcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaactaaaaaaaaaagaaaaacccgggctttttttgggggcggaaaggggttgaa

SEQ ID NO: 68118 - DNA, 1115 bp, Homo sapiens
tgacaggctgtgcgctctggggcacctcatgcagacgggagtagggaggctgttttttgcgcgtgcatatgcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaaaaaaaaaaaaaaaaaagaaaaaaagaaaaacaaaaaacaaaaaaaaaaaaaaaaaaaaaaaaaacaaaagggggggttatatgggcggggggggaaaaaggggttgaaaggggcatgggaatgggtccgggacccgttttttggccaagggggaaaggggggcccaaaggggggaaaatggaaaccggtacgac

SEQ ID NO: 68119 - DNA, 1158 bp, Homo sapiens
tgacaggctgtgcgctctggggcacctcatgcagacgggagtagggaggctgttttttgcgcgtgcatatgcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtggctgctgagtggaactgatgaaatgtggaactgtgttgggctggcttctgtccccaactccccaacatttaacaggaccgggacccccatcaggtacttaggactggaggaattatcactcatgtttacaagtccagacagtgaaaataggtgggttcccccatatcattcttgttatttgcaatcctcctgctcccctgattactgccttcttgattggccacactttcccttctgctggatcctatttctgttgctgttgatgaggtgctagggtcttcaaggtaacaagccccactgatttctctgga

SEQ ID NO: 68120 - DNA, 1088 bp, Homo sapiens
accccatcccccactcctataccggtcctccattttggtgcctgcaaagctctgggaaagaatcccgggaaacgaaaaatggtgggtttgggggaagggaggtaaggggagaaagctggagggaggggctttaattggaggccccgtagaggacgcgcggaacttctaaggtgggaaaaaacgaaattaaaaaaatcctttgatatcagggctctgaatcctgctggtcagagcaccaagcattcagtctctctccttgcctttgtcttacttgtgttcaaagaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaaaaaaaaaaaaaaaaaagaaaaaaagaaaaacaaaaaacaaaaaaaaaaaaaaaaaaaaaaaaaacaaaagggggggttatatgggcggggggggaaaaaggggttgaaaggggcatgggaatgggtccgggacccgttttttggccaagggggaaaggggggcccaaaggggggaaaatggaaaccggtacgac

SEQ ID NO: 68121 - DNA, 459 bp, Homo sapiens
atcctcggagaagcaggatgagggagagagacagagaaagagagggagagagagccgagttttgatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaa

SEQ ID NO: 68122 - DNA, 685 bp, Homo sapiens
cccccccccccccccccccgactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaa

SEQ ID NO: 68123 - DNA, 539 bp, Homo sapiens
ggacgcgtgggggagatctctggatccatgaccatccttttccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaaaaaaaaaaaaaaaaacaacaaaaaacaaaaaaaaaacccaacaaaaaaaaaaaaaaaaaaaaaaaaaagaaaaaaagaaaaacaaaaaacaaaaaaaaaaaaaaaaaaaaaaaaaacaaaagggggggttatatgggcggggggggaaaaaggggttgaaaggggcatgggaatgggtccgggacccgttttttggccaagggggaaaggggggcccaaaggggggaaaatggaaaccggtacgac

SEQ ID NO: 68124 - DNA, 739 bp, Homo sapiens
cccccccccccccccccccgactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaa

SEQ ID NO: 68125 - DNA, 818 bp, Homo sapiens
gaaacgcgcacaccgccgccacggcaaagtcacgggcgtcactacggctagtagagccccgtggttatcggcgaggcggcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaa

SEQ ID NO: 68126 - DNA, 898 bp, Homo sapiens
tgacaggctgtgcgctctggggcacctcatgcagacgggagtagggaggctgttttttgcgcgtgcatatgcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggcccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcaccaatgtggtggttaagctatgcatt

SEQ ID NO: 68127 - DNA, 995 bp, Homo sapiens
tcatcgctgtctggaacagcagatgactcgagagcgggcgtgcatatgcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtctgcgaggctaagtgtctccgcggcgcacctcgcggcgagaatccggaggagaaggagactgcaaggataggccaaaaacaaccagaaaaaaaaaatctcatcatggcaaatattcaccaggaaaacgaagagatggagcagcctatgcagaatggagaggaagaccgccctttgggaggaggtgaaggccaccagcctgcaggaaatcgacggggacaggctcgccgacttgcccctaattttcgatgggccatacccaataggcagatcaatgatgggatgggtggagatggagatgatatggaaatattcatggaggagatgagagaaatcagaagaaaacttagggagctgcagttgaggaattgtctgcgtatccttatgggggagctctctaatcaccatgaccatcatgatgaattttgccttatgccttgactcctgccatttatcatgagattaatactgtgattcccgctgttttctttttccttgcattttcctaatatgcctttactgatccgtttgctgtgaaccctatgttatttccatgtgtcaagtgggtcttgtgttgccagcttctatttgaagattgcctttgcactcagtgtaagtttctgtcagcagtagtttcacccatttgcatggaaaaatttaaagctaataaagcaatttaaaaagcaatctatacatttattgtctcattaaaaatgtatacttacatataacagatgaac

SEQ ID NO: 68128 - DNA, 624 bp, Homo sapiens
ccagggctaaacttagagggaagctgtcatcaccctagggcctgaggaggaaggggagaaaatactgtttggggggcctggtgggagctgtagctgggaggaggaccatgagggagaaaccatagtcatggaaggatgttgtcactgccaggaccaagacaccaagactgtgtgctaggcactgagttagagttgaagaccctcaagaattccactgacaactgaatcatcaaagggaaccgagccctgcccaaggacatacagttgttttcctcttccttgtcctttggagaagcacagctgaagcttcctgcccacaccccagcccctcctccttgagcatgaatgtgcagaccacccaccgccccatgcttgtatctacaacagctatgaggaagaacatacagattaatcaccctgctgcgggatgccagctacccagtggctctggcagccccagtcaatggatcctgcagtgtagccttcatcagtagagctgccactgccagcacccaaaaggtagcactaatatgcatgtgtgacctgaaaattacaatgtaaatggtggggcaacacatgtataggaaggtaaattttaattaaaagtctgttctccaactcagc

SEQ ID NO: 68129 - DNA, 9589 bp, Homo sapiens
ccgaccaacaccaacacccagctccgacgcagctcctctgcgcccttgccgccctccgagccacagctttcctcccgctcctgcccccggcccgtcgccgtctccgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacatgagctgcaacggaggctcccacccgcggatcaacactctgggccgcatgatccgcgccgagtctggcccggacctgcgctacgaggtgaccagcggcggcgggggcaccagcaggatgtactattctcggcgcggcgtgatcaccgaccagaactcggacggctactgtcaaaccggcacgatgtccaggcaccagaaccagaacaccatccaggagctgctgcagaactgctccgactgcttgatgcgagcagagctcatcgtgcagcctgaattgaagtatggagatggaatacaactgactcggagtcgagaattggatgagtgttttgcccaggccaatgaccaaatggaaatcctcgacagcttgatcagagagatgcggcagatgggccagccctgtgatgcttaccagaaaaggcttcttcagctccaagagcaaatgcgagccctttataaagccatcagtgtccctcgagtccgcagggccagctccaagggtggtggaggctacacttgtcagagtggctctggctgggatgagttcaccaaacatgtcaccagtgaatgtttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgcgatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatcgtaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 68130 - DNA, 9017 bp, Homo sapiens
  misc_feature (7)..(7): n is a, c, g, or t
  misc_feature (30)..(30): n is a, c, g, or t
  misc_feature (50)..(50): n is a, c, g, or t
  misc_feature (92)..(92): n is a, c, g, or t
atgacantcgcattgtcttaaagagatatnattgacatataagtgttganatggtcatgagtgtttgaatgaaactttctggaggggagatntgagctctttgatcttctctgatgcttaccagaaaaggcttcttcagctccaagagcaaatgcgagccctttataaagccatcagtgtccctcgagtccgcagggccagctccaagggtggtggaggctacacttgtcagagtggctctggctgggatgagttcaccaaacatgtcaccagtgaatgtttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgcgatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatcgtaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 68131 - DNA, 8780 bp, Homo sapiens
gcgttctagaggatcccgcggagtagtggtgatcagtgaagggttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgcgatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatcgtaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 68132 - DNA, 459 bp, Homo sapiens
tttacctgagaccatagcttctcatcctcatttcttcttctggctttttggggcttacttttgtccacctgagcccctgaccaactttctccttcatttctctaagacctagggaatcctaaatgatgtctttaaactttaagacaattttctaacacgtgagtctttaagtgaccctgatctgggctttcctttgtggagacggtgctgccaggccagcaagggtttgctttccaaccgcctaggaaaaagtccccatgggtgaaatatctcatagagctagtaattctttctttctatggagggatctgaggccagtatctgaagaaaaggaggcttagaagggccactcttttctatacaatccacaaggggatttatatctacctgctttttgttgtcttctagcgcgagaaatctgcgatctaccagttggaggaggagtatgaaaacctgctg

SEQ ID NO: 68133 - DNA, 4124 bp, Homo sapiens
cccacctgtcctccccgtacgagcccgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 68134 - DNA, 7498 bp, Homo sapiens
acaatatttaaaggtctacatggtcactataaaacattaaattgcatcattctctaatggtagcaaaaaagatccaatggaaagtaaatgaatatcagcaatttagtggtagaaagacagaaatgcacgaaaagaacatgtcaaaagtaaagataactttattcaaactactggattatgggtctatcaattatttaaatttatacagggctataattaataaaaatcattaatcctatttggtacaaaaatgttaactatcatgctgttaaattacattcacctagaaaaatatataccattttattatgtaaaaataagttcattacattttattatgtaaaaaagcatttatattacctgttatatttaacatctcaaaaaactatttgctttggactatgaatgaacattcatttacataattcatcaagcaattattaagtggggctatagcaaggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatcgtaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 68135 - DNA, 1150 bp, Homo sapiens
acttaaatataaaacctaaaagtattaaattcctagaagaaaacccaggaaatgccattctggacataagtgctggaaaagacttaatgatgaacaccccaaagcaattgcaacaaaaacaaaaattgacaagtgggacctaattaaactaaataacttctgcacagcaaaagaagctatttgcagactacagaatgggagaaaatgtttacaaactgcatctgacaaagatctaatccagaatctataaagaactcaaacaaatcaacaatgagaaaaacaaccccattaaaaactgggcaaaggccatgaatagacctttctcaaaagaatacatacatgtggcaataagcatatgaaaaaaatggttaatatcgctaatcattaaggaaatgcaatcaaagccacaatgagataccatctcagacctgtctgaatgggtattatcagaatgggtattattaaaaaatcaaaacatagatgctagtgaggctgcagagaaaagcaaatacttatacactgctggtgggaatgtaaattaattcagccattgtggaaagcactgcagcgatttctcaaagacataaaagcacatagcattcaacccagcatcccattactgggtgtatacctaaaggaatataatcattccaccataaagacaaacacttgtatgttcattgcagcactattctcaatagcaaagatgtggaatcaacgtaaatgcccatcagcagtagaccagataaagaaaatttggtacatatacaccatggaatactatgcagccataaaaaagaacaagactgtgtcctttacagcaacatagatggagctgaggctcttatcctaagtgaattaatgcaggaacagaaaatgaaatatcccatgttctcacttataagtgggagctaaacattgattacacatggactcaaagaagggaacagtagacacgggcttatgggtggaggttgggaagaggatgaagattgaataactgcctgttgggtactatgctgattacctggggacaaaattaactgtacaccaaactcctgcaacatgcagttgacccatgtacacatactccttgaacctaaaataaaacatgaaaaaaagcaaatttcacaccttgtaaaacatcaag

SEQ ID NO: 68136 - DNA, 494 bp, Homo sapiens
ctcccaaactgctgggattataggcgtgagccactccactccgggccatacgtcttttctaaatgctcccaaaccactgtttaacaacatcctaaagactttctaggccatgagaggtatcatgttctggaattcgcctttttgaaaatcagtgtcttcactgttctcacacgtctactataaataaggggagtaatttaattcctattatatgtatgtgtatgtatatgtacatatatgtgtatttttatatgtgtgtatatgtatctataggtatatatatttatgtatagcagtaattacctgtttaatgaatgaatggtgatgatttaaatgtaaagggaatgatgccagaggttatgaaaaaaagctgccttcaaaatatgaaatagagaaagaatagagaaatgcatgccaagctctaaataatttattgtaatttacttggttcttggttttctaaaatggaaataaagagataatattgagcttaa

SEQ ID NO: 68137 - DNA, 334 bp, Homo sapiens
agcaactgaaatgctgtaaggctggaattgcattcttgcaattgccagtgacctgattcaggatacattcccttgatctagatcatatgacttatttcttgaccaacctgttagaaatttccactctggtgattttcctccagtatgtaccactgggtatctgttactatactctgtacatttgtcttttgcttatcaggaggctattatcatacctaaaatctgtgtttgtcccctatttcacttgagtgcctgacactttcagatgaaaaagtcttggttcctcttagtattcctttgtttccactggagttaagggtcagtaatgagaatg

SEQ ID NO: 68138 - DNA, 415 bp, Homo sapiens
gataattgttgatctgcttcaatctgtgtctccctgctccaatccgtgtctctctgtgggcccttgctcagagatgccatgtggtgtctgaacttgaccagactccctgagggcagccaccagtttcttcagaggcagcagctgtgggattgagccccagaagtgagtttacactcccttttccagggcttaggatctctgcttctcttccctctgtgataaagccaatttcaacttcagggtcaggtaatcacttgacacgtctatcaaggaaaagcaataaaaccctaaacaattttgcattagatcagactagctctgtcttctctcccagggaaaggctgccacctgctgtaaaacatcagcactgggcttttccaaggtcactgaacaaccacttcctcccatacaaaat

SEQ ID NO: 68139 - DNA, 538 bp, Homo sapiens
aaacacatcatcactccatttaccagattagcttgaagaaagcagggtttgaaaggcagaggacctggggcaagaagtaggattgaaataaaaggatgctcggggctgcagtgaggttagagtgagcgttatcatagtttggaaatctggcattgaatacctgaattttacttgctattctgtttctcagcaactatatgacttggcttagtcagtgctcctctcacagctcagttttcttttctgtaagatacaggggtcctgggcagggagggaatagttgtccttcagggtagtggttcttgaacctggcctcagaatcactttggagaactgatttaaaatggctgccccatttcttctctgaatattctgattcaaatggactgcagtaggcccagaaatctttatttgttgttcgtcttatttttaatgtaaattagttattttaaaattgctaactgcatgcattaggttaagaattctaaaataaataagtaaataaaagtacatatatatgggaagatttccttccaat

SEQ ID NO: 68140 - DNA, 287 bp, Homo sapiens
tcacatgtaatacaactgaattgtaataattaggaacagaagcataatagctatgacaatgctgaacaaagctatattaataaatgagttactaaaaagaagccaaaatcctatttaagaaatcatatttatcacaatcaagtaggaattacagaattggcatcatactagttgagtgaagcagaaaagttcataaaacttttgcatgattcccagggccaccatggaaggttgtgcaggttgtacactacactaatctagggcatgccatttgcatcaagtgtttt

SEQ ID NO: 68141 - DNA, 382 bp, Homo sapiens
  misc_feature (48)..(48): n is a, c, g, or t
  misc_feature (70)..(70): n is a, c, g, or t
  misc_feature (72)..(72): n is a, c, g, or t
cgacgcccctccggcagagaccaccgcgtcgctggggccagaggggcnggtggtctctcgccccagcagncngacgcggcccgcggggacgtcgctgtccgtcctgctcgccctgtgccctctcactgacttctcccgggtcgtgtcttttaaaaactcctgttttcacaccttacaaagccagctctgagcagacagggcgtcctctcgtagaacctgcgcaccccgttcccagcgcatggcgccccgggccgcgagcttagcttagaccgtggtgtcctctgtccgtctgtcctgcgcctgcgcctcctcctgcatgtcggggcccctgcgtgtgttctctccggatggaatcacagccaataaacaccagtgatttcac

SEQ ID NO: 68142 - DNA, 747 bp, Homo sapiens
ggcacgagggtgacgcgccctcctcgcggtgcccttcagccgccgccgcagctcaccgggcgccacatggacccagccggcccgagcgcgccccgccgctgaccgcccgcgccccgggaaggaagaacactcgctcccggccatacttgcgtgtgagttctgacccctggaggagccactgtggaagcagagcaatcgccatggagtttgtgatgaagcaggctctaggaggggccaccaaggacatggggaagatgctggggggtgacgaggagaaggaccgccgcctccctcacccggcaaggggcgcgcgcccccaggacccccccagtccgccccgtgctcctctgcccgcgggtggctggagccccatcgcctgggacgcccctttctcttgctgtttaccgcccacccagcagcgcccgaggccagggctcgaccgtagacgtggcagacccccggcgaaggcacctcctgttgcgacgcggttcagcgagctgtggttggggccgacactggtcggggaccacgtctgcctacagggtaggtcgaccagcttgcatatgacaacgaccgcggtgggcgtccttgccgtgtggccgcggggcagatggcggccgggcggggggcgcctggggggtccgctcccttcccttcgcaaccgcggtggacttcctggcggagttgcaggggttctcggctcgcggaccgattgagcgctatttgagacgttcccggcaccggccg

SEQ ID NO: 68143 - DNA, 307 bp, Homo sapiens
cccgggcaggagggtcagggccagatggaggggccaccaaggacatggggaagatgctggggggtgacgaggagaaggagttttgcttcttacgaacgccacggccgtgttcacttctaaactaaaggaaacaaagcaataggtttgggggacgcccagccccttcttctgttattgcttatttctaatattatggtgattatacttaatttttatcataaaaaacttggtggttgggtaaaaatcccaaggaatatctttgttctaaagatttgtttatttctacctattttagaatcttttgtga

SEQ ID NO: 68144 - DNA, 1845 bp, Homo sapiens
tctcaaggaagatgggagcctccccctccctgctcccccccatgtcagctcctggcccccattctccgtgggggcttcccattcctccagggaccccccgggtacggcatcaagaagaaggaggagcgcgaggccgaggcccaggccgccatggaggccaactccgaggggagcttgacgcggcccaagaaggccatcccgccgggctgcggggacgaggtggaggaggaggacgagagcatcctggacaccgtcatcaagtacctgcccgggccgctgcaggacatgctcaagaagtagccccgcgcgggacagcggccccgcggagcccccgcccctccccctacagatcctccgcggaggcccctgagggacgagcagagcgcagcccccacgccgatataagccatagccccaggcccgccctgcccgcgcccgccgcctccctcacccggcaaggggcgcgcgcccccaggacccccccagtccgccccgtgctcctctgcccgcgggtggctggagccccatcgcctgggacgcccctttctcttgctgtttaccgcccacccagcagcgcccgaggccagggccgccgaagggcagccccgcgaccacccctgtgcgcgcgttcgcggcggtgggcgcctgtcgggcccgcactcaggagcacagccatagcagacgggggggtgcgggcggggcgagggcggcggggcctgggtccccctcctgcacgcggactccggggttcggatcgctccgccgtgagtatttgcgtccgcacgcggccgctctccgccccccggcctggccccctcgcgcccctgtccatccgtctctgtccgcgtcctttcctctcctctctggaaggttttgcttcttacgaacgccacggccgtgttcacttctaaactaaaggaaacaaagcaataggtttgggggacgcccagcccccacccccgtcaccccgctcttcccaagtcctcgccccccgcccggcctcctagcctctccgcccacgcggctgctgcttctccctggggaggacccctgccctcggccattgaacactgcaccctccacaggagccgcagaggcccgaggcaccggacgctggagaccctgcgcccctgcccagcacctcctccgtgggcagctcctcgggtggggcctgcggggttccctgcgcgcagctggcgcgtgtgtggcctaatccacctggtggccctgcggggcggcatccgagcccctgtttctcctccattcatgtttaatttgcatcacaatttgttgaatctcaggtaaatgaggtctttgcatttaatgagttttatcttgacaggcgccgcctcgcccccgggccctttcgtccacatcaaaaatgcatcaagtctccacgtgtttcgggccagggcgtggcttggcattgaccttcatgaccttacatagctttagagaagccataacgttagactgcaatactaacgaccgacgcccctccgggcagagaccaccgcgcccctctgcgccccagcgacgcggcccgcggggacgtcgctgtccgtcctgctcgccctgtgccctctcactgacttctcccgggtcgtgtcttttaaaaactcctgttttcacaccttacaaagccagctctgagcagacagggcgtcctctcgtagaacctgcgcaccccgttcccagcgcatggcgccccgggccgcgagcttagcttagaccgtggtgtcctctgtccgtctgtcctgcgcctgcgcctcctcctgcatgtcggggcccctgcgtgtgttctctccggatggaatcacagccaataaacaccagtgatttcac

SEQ ID NO: 68145 - DNA, 1422 bp, Homo sapiens
ggcacgagggtgacgcgccctcctcgcggtgcccttcagccgccgccgcagctcaccgggcgccacatggacccagccggcccgagcgcgccccgccgctgaccgcccgcgccccgggaaggaagaacactcgctcccggccatacttgcgtgtgagttctgacccctggaggagccactgtggaagcagagcaatcgccatggagtttgtgatgaagcaggctctaggaggggccaccaaggacatggggaagatgctggggggtgacgaggagaaggacccagacgccgccaagaaggaggaggagcggcaggaggcgctgcgccaggcggaggaggagcgcaaggccaagtacgccaagatggaggcggagcgcgaggccgtgcgccagggcatccgagacaagtacggcatcaagaagaaggaggagcgcgaggccgaggcccaggccgccatggaggccaactccgaggggagcttgacgcggcccaagaaggccatcccgccgggctgcggggacgaggtggaggaggaggacgagagcatcctggacaccgtcatcaagtacctgcccggctcctagcctctccgcccacgcggctgctgcttctccctggggaggacccctgccctcggccattgaacactgcaccctccacaggagccgcagaggcccgaggcaccggacgctggagaccctgcgcccctgcccagcacctcctccgtgggcagctcctcgggtggggcctgcggggttccctgcgcgcagctggcgcgtgtgtggcctaatccacctggtggccctgcggggcggcatccgagcccctgtttctcctccattcatgtttaatttgcatcacaatttgttgaatctcaggtaaatgaggtctttgcatttaatgagttttatcttgacaggcgccgcctcgcccccgggccctttcgtccacatcaaaaatgcatcaagtctccacgtgtttcgggccagggcgtggcttggcattgaccttcatgaccttacatagctttagagaagccataacgttagactgcaatactaacgaccgacgcccctccgggcagagaccaccgcgcccctctgcgccccagcgacgcggcccgcggggacgtcgctgtccgtcctgctcgccctgtgccctctcactgacttctcccgggtcgtgtcttttaaaaactcctgttttcacaccttacaaagccagctctgagcagacagggcgtcctctcgtagaacctgcgcaccccgttcccagcgcatggcgccccgggccgcgagcttagcttagaccgtggtgtcctctgtccgtctgtcctgcgcctgcgcctcctcctgcatgtcggggcccctgcgtgtgttctctccggatggaatcacagccaataaacaccagtgatttcac

SEQ ID NO: 68146 - DNA, 1924 bp, Homo sapiens
ggcacgagggtgacgcgccctcctcgcggtgcccttcagccgccgccgcagctcaccgggcgccacatggacccagccggcccgagcgcgccccgccgctgaccgcccgcgccccgggaaggaagaacactcgctcccggccatacttgcgtgtgagttctgacccctggaggagccactgtggaagcagagcaatcgccatggagtttgtgatgaagcaggctctaggaggggccaccaaggacatggggaagatgctggggggtgacgaggagaaggacccagacgccgccaagaaggaggaggagcggcaggaggcgctgcgccaggcggaggaggagcgcaaggccaagtacgccaagatggaggcggagcgcgaggccgtgcgccagggcatccgagacaagtacggcatcaagaagaaggaggagcgcgaggccgaggcccaggccgccatggaggccaactccgaggggagcttgacgcggcccaagaaggccatcccgccgggctgcggggacgaggtggaggaggaggacgagagcatcctggacaccgtcatcaagtacctgcccgggccgctgcaggacatgctcaagaagtagccccgcgcgggacagcggccccgcggagcccccgcccctccccctacagatcctccgcggaggcccctgagggacgagcagagcgcagcccccacgccgatataagccatagccccaggcccgccctgcccgcgcccgccgcctccctcacccggcaaggggcgcgcgcccccaggacccccccagtccgccccgtgctcctctgcccgcgggtggctggagccccatcgcctgggacgcccctttctcttgctgtttaccgcccacccagcagcgcccgaggccagggccgccgaagggcagccccgcgaccacccctgtgcgcgcgttcgcggcggtgggcgcctgtcgggcccgcactcaggagcacagccatagcagacgggggggtgcgggcggggcgagggcggcggggcctgggtccccctcctgcacgcggactccggggttcggatcgctccgccgtgagtatttgcgtccgcacgcggccgctctccgccccccggcctggccccctcgcgcccctgtccatccgtctctgtccgcgtcctttcctctcctctctggaaggttttgcttcttacgaacgccacggccgtgttcacttctaaactaaaggaaacaaagcaataggtttgggggacgcccagcccccacccccgtcaccccgctcttcccaagtcctcgccccccgcccggcctcctagcctctccgcccacgcggctgctgcttctccctggggaggacccctgccctcggccattgaacactgcaccctccacaggagccgcagaggcccgaggcaccggacgctggagaccctgcgcccctgcccagcacctcctccgtgggcagctcctcgggtggggcctgcggggttccctgcgcgcagctggcgcgtgtgtggcctaatccacctggtggccctgcggggcggcatccgagcccctgtttctcctccattcatgtttaatttgcatcacaatttgttgaatctcaggtaaatgaggtctttgcatttaatgagttttatcttgacaggcgccgcctcgcccccgggccctttcgtccacatcaaaaatgcatcaagtctccacgtgtttcgggccagggcgtggcttggcattgaccttcatgaccttacatagctttagagaagccataacgttagactgcaatactaacgaccgacgcccctccgggcagagaccaccgcgcccctctgcgccccagcgcctgcgcctcctcctgcatgtcggggcccctgcgtgtgttctctccggatggaatcacagccaataaacaccagtgatttcac

SEQ ID NO: 68147 - DNA, 2150 bp, Homo sapiens
ggcacgagggtgacgcgccctcctcgcggtgcccttcagccgccgccgcagctcaccgggcgccacatggacccagccggcccgagcgcgccccgccgctgaccgcccgcgccccgggaaggaagaacactcgctcccggccatacttgcgtgtgagttctgacccctggaggagccactgtggaagcagagcaatcgccatggagtttgtgatgaagcaggctctaggaggggccaccaaggacatggggaagatgctggggggtgacgaggagaaggacccagacgccgccaagaaggaggaggagcggcaggaggcgctgcgccaggcggaggaggagcgcaaggccaagtacgccaagatggaggcggagcgcgaggccgtgcgccagggcatccgagacaagtacggcatcaagaagaaggaggagcgcgaggccgaggcccaggccgccatggaggccaactccgaggggagcttgacgcggcccaagaaggccatcccgccgggctgcggggacgaggtggaggaggaggacgagagcatcctggacaccgtcatcaagtacctgcccgggccgctgcaggacatgctcaagaagtagccccgcgcgggacagcggccccgcggagcccccgcccctccccctacagatcctccgcggaggcccctgagggacgagcagagcgcagcccccacgccgatataagccatagccccaggcccgccctgcccgcgcccgccgcctccctcacccggcaaggggcgcgcgcccccaggacccccccagtccgccccgtgctcctctgcccgcgggtggctggagccccatcgcctgggacgcccctttctcttgctgtttaccgcccacccagcagcgcccgaggccagggccgccgaagggcagccccgcgaccacccctgtgcgcgcgttcgcggcggtgggcgcctgtcgggcccgcactcaggagcacagccatagcagacgggggggtgcgggcggggcgagggcggcggggcctgggtccccctcctgcacgcggactccggggttcggatcgctccgccgtgagtatttgcgtccgcacgcggccgctctccgccccccggcctggccccctcgcgcccctgtccatccgtctctgtccgcgtcctttcctctcctctctggaaggttttgcttcttacgaacgccacggccgtgttcacttctaaactaaaggaaacaaagcaataggtttgggggacgcccagcccccacccccgtcaccccgctcttcccaagtcctcgccccccgcccggcctcctagcctctccgcccacgcggctgctgcttctccctggggaggacccctgccctcggccattgaacactgcaccctccacaggagccgcagaggcccgaggcaccggacgctggagaccctgcgcccctgcccagcacctcctccgtgggcagctcctcgggtggggcctgcggggttccctgcgcgcagctggcgcgtgtgtggcctaatccacctggtggccctgcggggcggcatccgagcccctgtttctcctccattcatgtttaatttgcatcacaatttgttgaatctcaggtaaatgaggtctttgcatttaatgagttttatcttgacaggcgccgcctcgcccccgggccctttcgtccacatcaaaaatgcatcaagtctccacgtgtttcgggccagggcgtggcttggcattgaccttcatgaccttacatagctttagagaagccataacgttagactgcaatactaacgaccgacgcccctccgggcagagaccaccgcgcccctctgcgccccagcgacgcggcccgcggggacgtcgctgtccgtcctgctcgccctgtgccctctcactgacttctcccgggtcgtgtcttttaaaaactcctgttttcacaccttacaaagccagctctgagcagacagggcgtcctctcgtagaacctgcgcaccccgttcccagcgcatggcgccccgggccgcgagcttagcttagaccgtggtgtcctctgtccgtctgtcctgcgcctgcgcctcctcctgcatgtcggggcccctgcgtgtgttctctccggatggaatcacagccaataaacaccagtgatttcac

SEQ ID NO: 68148 - DNA, 1984 bp, Homo sapiens
ctccaggctgacgaccgccagagccgtctctgggactctgcaggcacttcccgagcccccgcaaggggccaccaaggacatggggaagatgctggggggtgacgaggagaaggacccagacgccgccaagaaggaggaggagcggcaggaggcgctgcgccaggcggaggaggagcgcaaggccaagtacgccaagatggaggcggagcgcgaggccgtgcgccagggcatccgagacaagtacggcatcaagaagaaggaggagcgcgaggccgaggcccaggccgccatggaggccaactccgaggggagcttgacgcggcccaagaaggccatcccgccgggctgcggggacgaggtggaggaggaggacgagagcatcctggacaccgtcatcaagtacctgcccgggccgctgcaggacatgctcaagaagtagccccgcgcgggacagcggccccgcggagcccccgcccctccccctacagatcctccgcggaggcccctgagggacgagcagagcgcagcccccacgccgatataagccatagccccaggcccgccctgcccgcgcccgccgcctccctcacccggcaaggggcgcgcgcccccaggacccccccagtccgccccgtgctcctctgcccgcgggtggctggagccccatcgcctgggacgcccctttctcttgctgtttaccgcccacccagcagcgcccgaggccagggccgccgaagggcagccccgcgaccacccctgtgcgcgcgttcgcggcggtgggcgcctgtcgggcccgcactcaggagcacagccatagcagacgggggggtgcgggcggggcgagggcggcggggcctgggtccccctcctgcacgcggactccggggttcggatcgctccgccgtgagtatttgcgtccgcacgcggccgctctccgccccccggcctggccccctcgcgcccctgtccatccgtctctgtccgcgtcctttcctctcctctctggaaggttttgcttcttacgaacgccacggccgtgttcacttctaaactaaaggaaacaaagcaataggtttgggggacgcccagcccccacccccgtcaccccgctcttcccaagtcctcgccccccgcccggcctcctagcctctccgcccacgcggctgctgcttctccctggggaggacccctgccctcggccattgaacactgcaccctccacaggagccgcagaggcccgaggcaccggacgctggagaccctgcgcccctgcccagcacctcctccgtgggcagctcctcgggtggggcctgcggggttccctgcgcgcagctggcgcgtgtgtggcctaatccacctggtggccctgcggggcggcatccgagcccctgtttctcctccattcatgtttaatttgcatcacaatttgttgaatctcaggtaaatgaggtctttgcatttaatgagttttatcttgacaggcgccgcctcgcccccgggccctttcgtccacatcaaaaatgcatcaagtctccacgtgtttcgggccagggcgtggcttggcattgaccttcatgaccttacatagctttagagaagccataacgttagactgcaatactaacgaccgacgcccctccgggcagagaccaccgcgcccctctgcgccccagcgacgcggcccgcggggacgtcgctgtccgtcctgctcgccctgtgccctctcactgacttctcccgggtcgtgtcttttaaaaactcctgttttcacaccttacaaagccagctctgagcagacagggcgtcctctcgtagaacctgcgcaccccgttcccagcgcatggcgccccgggccgcgagcttagcttagaccgtggtgtcctctgtccgtctgtcctgcgcctgcgcctcctcctgcatgtcggggcccctgcgtgtgttctctccggatggaatcacagccaataaacaccagtgatttcac

SEQ ID NO: 68149 - DNA, 2174 bp, Homo sapiens
  misc_feature (2152)..(2152): n is a, c, g, or t
ggcacgagggtgacgcgccctcctcgcggtgcccttcagccgccgccgcagctcaccgggcgccacatggacccagccggcccgagcgcgccccgccgctgaccgcccgcgccccgggaaggaagaacactcgctcccggccatacttgcgtgtgagttctgacccctggaggagccactgtggaagcagagcaatcgccatggagtttgtgatgaagcaggctctaggaggggccaccaaggacatggggaagatgctggggggtgacgaggagaaggacccagacgccgccaagaaggaggaggagcggcaggaggcgctgcgccaggcggaggaggagcgcaaggccaagtacgccaagatggaggcggagcgcgaggccgtgcgccagggcatccgagacaagtacggcatcaagaagaaggaggagcgcgaggccgaggcccaggccgccatggaggccaactccgaggggagcttgacgcggcccaagaaggccatcccgccgggctgcggggacgaggtggaggaggaggacgagagcatcctggacaccgtcatcaagtacctgcccgggccgctgcaggacatgctcaagaagtagccccgcgcgggacagcggccccgcggagcccccgcccctccccctacagatcctccgcggaggcccctgagggacgagcagagcgcagcccccacgccgatataagccatagccccaggcccgccctgcccgcgcccgccgcctccctcacccggcaaggggcgcgcgcccccaggacccccccagtccgccccgtgctcctctgcccgcgggtggctggagccccatcgcctgggacgcccctttctcttgctgtttaccgcccacccagcagcgcccgaggccagggccgccgaagggcagccccgcgaccacccctgtgcgcgcgttcgcggcggtgggcgcctgtcgggcccgcactcaggagcacagccatagcagacgggggggtgcgggcggggcgagggcggcggggcctgggtccccctcctgcacgcggactccggggttcggatcgctccgccgtgagtatttgcgtccgcacgcggccgctctccgccccccggcctggccccctcgcgcccctgtccatccgtctctgtccgcgtcctttcctctcctctctggaaggttttgcttcttacgaacgccacggccgtgttcacttctaaactaaaggaaacaaagcaataggtttgggggacgcccagcccccacccccgtcaccccgctcttcccaagtcctcgccccccgcccggcctcctagcctctccgcccacgcggctgctgcttctccctggggaggacccctgccctcggccattgaacactgcaccctccacaggagccgcagaggcccgaggcaccggacgctggagaccctgcgcccctgcccagcacctcctccgtgggcagctcctcgggtggggcctgcggggttccctgcgcgcagctggcgcgtgtgtggcctaatccacctggtggccctgcggggcggcatccgagcccctgtttctcctccattcatgtttaatttgcatcacaatttgttgaatctcaggtaaatgaggtctttgcatttaatgagttttatcttgacaggcgccgcctcgcccccgggccctttcgtccacatcaaaaatgcatcaagtctccacgtgtttcgggccagggcgtggcttggcattgaccttcatgaccttacatagctttagagaagccataacgttagactgcaatactaacgaccgacgcccctccgggcagagaccaccgcgcccctctgcgccccagcgacgcggcccgcggggacgtcgctgtccgtcctgctcgccctgtgccctctcactgacttctcccgggtcgtgtcttttaaaaactcctgttttcacaccttacaaagccagctctgagcagacagggcgtcctctcgtagaacctgcgcaccccgttcccagcgcatggcgccccgggccgcgagcttagcttagaccgtggtgtcctctgtccgtctgtcctgcgcctgcgcctcctcctgcatgtcggggcccctgcgtgtgttctctccggatggaatcacagccaataaacaccagtgatttcacgnagcacataataaaaaataaaaa

SEQ ID NO: 68150 - DNA, 1054 bp, Homo sapiens
cccgggcaggagggtcagggccagatggaggggccaccaaggacatggggaagatgctggggggtgacgaggagaaggagttttgcttcttacgaacgccacggccgtgttcacttctaaactaaaggaaacaaagcaataggtttgggggacgcccagcccccacccccgtcaccccgctcttcccaagtcctcgccccccgcccggcctcctagcctctccgcccacgcggctgctgcttctccctggggaggacccctgccctcggccattgaacactgcaccctccacaggagccgcagaggcccgaggcaccggacgctggagaccctgcgcccctgcccagcacctcctccgtgggcagctcctcgggtggggcctgcggggttccctgcgcgcagctggcgcgtgtgtggcctaatccacctggtggccctgcggggcggcatccgagcccctgtttctcctccattcatgtttaatttgcatcacaatttgttgaatctcaggtaaatgaggtctttgcatttaatgagttttatcttgacaggcgccgcctcgcccccgggccctttcgtccacatcaaaaatgcatcaagtctccacgtgtttcgggccagggcgtggcttggcattgaccttcatgaccttacatagctttagagaagccataacgttagactgcaatactaacgaccgacgcccctccgggcagagaccaccgcgcccctctgcgccccagcgacgcggcccgcggggacgtcgctgtccgtcctgctcgccctgtgccctctcactgacttctcccgggtcgtgtcttttaaaaactcctgttttcacaccttacaaagccagctctgagcagacagggcgtcctctcgtagaacctgcgcaccccgttcccagcgcatggcgccccgggccgcgagcttagcttagaccgtggtgtcctctgtccgtctgtcctgcgcctgcgcctcctcctgcatgtcggggcccctgcgtgtgttctctccggatggaatcacagccaataaacaccagtgatttcac

SEQ ID NO: 68151 - DNA, 1168 bp, Homo sapiens
ggcacgagggtgacgcgccctcctcgcggtgcccttcagccgccgccgcagctcaccgggcgccacatggacccagccggcccgagcgcgccccgccgctgaccgcccgcgccccgggaaggaagaacactcgctcccggccatacttgcgtgtgagttctgacccctggaggagccactgtggaagcagagcaatcgccatggagtttgtgatgaagcaggctctaggaggggccaccaaggacatggggaagatgctggggggtgacgaggagaaggacccagacgccgccaagaaggaggaggagcggcaggaggcgctgcgccaggcggaggaggagcgcaaggccaagtacgccaagatggaggcggagcgcgaggccgtgcgccagggcatccgagacaagtacggcatcaagaagaaggaggagcgcgaggccgaggcccaggccgccatggaggccaactccgaggggagcttgacgcggcccaagaaggccatcccgccgggctgcggggacgaggtggaggaggaggacgagagcatcctggacaccgtcatcaagtacctgcccgggccgctgcaggacatgctcaagaagtagccccgcgcgggacagcggccccgctgtgagcaacgcgaggggagttcctggttggccaatccaaggatgtgcgacatgtcatagagacagaccggagctgagagacaagacgtgtgctcaagccttcgtgtcatgaaggccatgcagtctctcaagtcccgaggctacgtgaaggaacagtttgcctggagacatttccatacctggtaccttacacaagtgagggatatacaagtagtctacagatgattaccttcatctgcccccggagattgtgcctgccacccgtacgaccgatagccgtccagagactggccagggacctcgagctaaaggtctggaggggtgagcagacctgcgagaatcacaagaggggaagctgcacagcagatacctacagacggagtgctgtgccacctggtgccgacagaaagccgaggctggggctgggtcagaaccgaattccagttaagaggcggattgggccgtggacagtggtcagcactcagtaaaatcggagaggatcttattggctgaataacttacagcaacaaaaacaacga

SEQ ID NO: 68152 - DNA, 480 bp, Homo sapiens
tttattacttaagctattctttcactcatctatcatcctttattcaccaaatcacatgctcttcccaatacctgaatacatcttttgcatctagttcacctagaaaacccatactcattcttcaagactgggttcaaatatcatctcttctgaaaggcctcttacaacactccacaccattgcagaggaggaataagagcttcctcctctgtgctcccatcactgcttacatgtgtgcacctctccattacagtccacatcacatagttgtaactgtgtttataggttaggcttctccagtagacagtgagatgaattcaagaaccaccagtcatatctttcattgtatcctcagcacttaatatagtgcctgccacagggtaggcatttaattaatagttcttaagtgtgtgactgaattgatgaatggatgtatgaagataaaaaaaacaggtaaccctcacatttacatgcccagca

SEQ ID NO: 68153 - DNA, 581 bp, Homo sapiens
aaaagaatattctgacaactgtgtggagaataaactgtagggggaggcaagggtacaagctgaggcaggaaaattgcttgaacctgggaggtgcaggttagagtgagccaagatcgtgcggctgtactctagcctgggcggcagagtgagactccatcccaccccccaaaaaaagcatgttgaatacttaagcattctattaaaatcagtataacatattttatcccaattgtgtagtataataaaatataatttttagagtagtttgctataaagaatctgactataaacgtaaatacttgaagcatgctaagaagtatggaaactacttactcgtgccaaattcaaattattctttatatacagctacttgactgatgtaaaatatgatgtgaaacattcaaacttgtttttaagtgttactatttctaaaacatgaaaattaaacccatttagaaatctggccattaactttcagtttccacaccagaggtgtttcccttaaagacatctatcagtataatattactattataatcccaacattaaattcaaaaatcaattaaaagtacttgaaatta

SEQ ID NO: 68154 - DNA, 930 bp, Homo sapiens
gcagaagagggagaggttcgtcttccaggctgcaccgcgctggcggcgagcgggttcacagggagccggcggcggtggtaccacagcctggtgatgtcagacaccagtggttctttcagaggggtctctccagccccaagcaggaagctgttttccttctgtgtgtgcagccaaggcccctggaggggctgagagtcggggctgagtcttcctggggccagggccccccaacaaggcctccgatgagccccagaggacctccctctcagtgtgaagatcattcaccgatgaagacagacccagttggatcccctttgtctgaattcaggagatgtccatttctggagcaagaacaggcaaagaaatactcctgtaatatgatggccttccttgctgacgaatactgcaactattgtcgagacattttacgaaatgtgaggaactgagaacttgagagggtagggttttatctataaaatacaagcatttatgactccttattaatcatttttatttgaagagaccccgtcaacagatgtccaatggtaacccactgcactgaagtgcttacatgctatgtacctatgttgtagtcattgagttctggaaggtgagatcgatattcagtgtaatcagttggaaattctccaaggtgctaatacagataactttaggctctaaatacaaattcagctattttttagatcctaattctgctcattttgaataaagtgttggtaataaaattcaccctggaattttcaatggtgccgaagagccatttgattgatacgcgctaactgaagatggagcaggacttcgcagctgagtgatctggcatgggtattgtcacgattggatttaatcctagaattggctgtggaaaacatgaataaatctttcagctattctgagtttcatcttctgcag

SEQ ID NO: 68155 - DNA, 825 bp, Homo sapiens
  misc_feature (113)..(113): n is a, c, g, or t
  misc_feature (277)..(277): n is a, c, g, or t
atgtggatgctgggagaagtatgtgagatggaaaagttgtttcatggcatccaagaagtgaatgatcctcaaggtgtagcagaggaatttgtaggagagagggatgattgacntcttcgtatagccctccatccatcccagttagcatggagggattttagggctaccattggctgggtagtggagtgttgaccaatcacagctcaggggcgtgattgtctcgtcctgggatcgcgagaggggtatatacagggaggccaggcagcctggagttagncgaccgttgcgagacgttgagctgcggaagatgagtccaaagccgagagcctcgggacctccggccaaggccacggaggcaggaaagaggaagtcctcctctcagccgagccccagtgacccgaagaagaagactaccaaggtggccaagaagggaaaagcagttcgtagagggagacgcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggagagccgagctggaggaaccactgagtcaggagagcgaggtggaagaaccactgactgtgtggatggccagcttttcccctgtctccgagagcagcgactaagttcaggcccagccgccagacctcagagatctcaccagcggggtgcttgccattctgaagataataaaatgaatgtgttgcaaattgaaaaaaaaaa

SEQ ID NO: 68156 - DNA, 739 bp, Homo sapiens
  misc_feature (113)..(113): n is a, c, g, or t
  misc_feature (277)..(277): n is a, c, g, or t
atgtggatgctgggagaagtatgtgagatggaaaagttgtttcatggcatccaagaagtgaatgatcctcaaggtgtagcagaggaatttgtaggagagagggatgattgacntcttcgtatagccctccatccatcccagttagcatggagggattttagggctaccattggctgggtagtggagtgttgaccaatcacagctcaggggcgtgattgtctcgtcctgggatcgcgagaggggtatatacagggaggccaggcagcctggagttagncgaccgttgcgagacgttgagctgcggaagatgagtccaaagccgagagcctcgggacctccggccaaggccacggaggcaggaaagaggaagcgggaagaaaggggctgcgacaaagatggcggccgtgacggcacctgaggcggagagcgcgccagcggcacccggccccagcgaccagcccagccaggagctccctcagcacgagctgccgccggaggagccagtgagcgaggggacccagcacgaccccctgagtcaggagagccgagctggaggaaccactgagtcaggagagcgaggtggaagaaccactgactgtgtggatggccagcttttcccctgtctccgagagcagcgactaagttcaggcccagccgccagacctcagagatctcaccagcggggtgcttgccattctgaagataataaaatgaatgtgttgcaaattgaaaaaaaaaa

SEQ ID NO: 68157 - DNA, 1537 bp, Homo sapiens
tgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaagacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatctccgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacccccgttttgatgagaatgctgtggtccgcaacacccagatcgacaactcctgggggtctgaggagcgaagtctgccccgaaaaatgcccttcgtccgtggccagagcttctcagtgtggatcttgtgtgaagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggc

SEQ ID NO: 68158 - DNA, 3179 bp, Homo sapiens
tttgtttttttgcagttggtacgccttattacatgtctccagagagaatacatgaaaatggatacaacttcaaatctgacatctggtctcttggctgtctactatatgagatggctgcattacaaagtcctttctatggtgacaaaatgaatttatactcactgtgtaagaagatagaacagtgtgactacccacctcttccttcagatcactattcagaagaactccgacagttagttaatatgtgcatcaacccagatccagagaagcgaccagacgtcacctatgtttatgacgtagcaaagaggatgcatgcatgcactgcaagcagctaaacatgcaagatcatgaagagtgtaaccaaagtaattgaaagtattttgtgcaagtcatacctccccatttatgtctggtgttaagattaatatttcagagctagtgtgctttgaatccttaaccagttttcatataagcttcattttgtaccagtcacctaaatcacctccttgcaacccccaaatgactttggaataactgaattgcatgttaggagagaaaatgaaacatgatggttttgaatggctaaaggtttatagaatttcttacagttttctgctgataaattgtgtttagatagactgtcagtgccaaatattgaaggtgcagcttggcacacatcagaatagactcatacctgagaaaaagtatctgaacatgtgacttgtttcttttttagtaatttatggacattgagatgaacacaattgtgaacttttgtgaagattttatttttaaacgtttgaagtactagttttagttcttagcagagtagttttcaaatatgattcttatgataaatgtagacacaaactatttgagaaacatttagaactcttagcttatacattcaaaatgtaactattaaatgtgaagatttggggacaaaatgtgagtcagacactgaagagttttttgttttgttttaatatttttgatattctctttgcattgaaatggtataaatgaatccatttaaaaagtggttaaggatttgtttagctggtgtgataataatttttaaagttgcacattgcccaaggctttttttgtgtgtttttattgttgtttgtacatttgaaaatgcattttaactcataattgtacactataatataagcctaagtttttattcataagttttattgaagttctgatcggtccccttcagaaatttttttatattattcttcaagttactttcttatttatattgtatgtgcattttatccattaatgtttcatactttctgagagtataatacccttttaaaagatatttggtataccaatacttttcctggattgaaaactttttttaaactttttaaaatttgggccactctgtatgcatatgtttggtcttgttaaagaggaagaaaggatgtgtgttatactgtacctgtgaatgttgatacagttacaatttatttgacaaggttgtaattctagaatatgcttaataaaatgaaaactggccatgactacagccagaactgttatgagattaacatttctattgagaagcttttgagtaaagtactgtatttgttcatgaagatgactgagatggtaacacttcgtgtagcttaaggaaatgggcagaatttcgtaaatgctgttgtgcagatgtgttttccctgaatgctttcgtattagtggcgaccagtttctcacagaattgtgaagcctgaaggccaagaggaagtcactgttaaaggactctgtgccatcttacaaccttggatgaattatcctgccaacgtgaaaacctcatgttcaaagaacacttccctttagccgatgtaactgctggttttgtttttcatatgtgtttttcttacactcatttgaatgctttcaagcatttgtaaacttaaaaaatgtataaagggcaaaaagtctgaacccttgttttctgaaatctaatcagttatgtatggtttctgaagggtaattttattttggaataggtaaaggaaacctgtttgtttgtttttcctgagggctagatgcattttttttctcacactcttaatgacttttaacatttatactgagcatccatagatatattcctagaagtatgagaagaattattcttattgaccattaatgtcatgttcattttaatgtaatataattgagatgaaatgttctctggttggaacagatactctctttttttttcttgcaatctttaagaatacatagatctaaaattcattagcttgacccctcaaagtaacttttaagtaaagattaaagcttttcttctcagtgaatatatctgctagaaggaaatagctgggaagaatttaatgatcagggaaattcattatttctatatgtggaaactttttgcttcgaatattgtatctttttaaatctaaatgttcatatttttcctgaagaaaccactgtgtaaaaatcaaattttaattttgaatggaataatttcaaagaactatgaagatgatttgaagctctaatttatatagtcacctataaaatgttctttatatgtgttcataagtaaattttatattgattaagttaaacttttgaattgatttgaggagcagtaaaatgaaagctatatctattctaaaccttatttagacattggtaccagttacccaggtgaaaatatggagtaactttgttttgtatggtaaggtttaggaatggtggatgaagggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatatttattttaaccaaaatgttactcacattaaatgtttattctttaaaatgaatgtattatgtttttaacccacaaatgcatacttaccctgtgcctcatatttcaatagtactgtaatatggacatcttttgtgaaatacttttattttgttatgctttaaatatacatacaaaaagatttctgttattagctttgaaaattgtataatatcctaatataaacaaaaatataaaaataaaaatgaatacagtaaaa

SEQ ID NO: 68159 - DNA, 2399 bp, Homo sapiens
agatgatgaaaacagaacttgtgaaggaatagtcggatttaatagaaacatttagaactcttagcttatacattcaaaatgtaactattaaatgtgaagatttggggacaaaatgtgagtcagacactgaagagttttttgttttgttttaatatttttgatattctctttgcattgaaatggtataaatgaatccatttaaaaagtggttaaggatttgtttagctggtgtgataataatttttaaagttgcacattgcccaaggctttttttgtgtgtttttattgttgtttgtacatttgaaaaatattctttgaataaccttgcagtactatatttcaatttctttataaatttaagtgcattttaactcataattgtacactataatataagcctaagtttttattcataagttttattgaagttctgatcggtccccttcagaaatttttttatattattcttcaagttactttcttatttatattgtatgtgcattttatccattaatgtttcatactttctgagagtataatacccttttaaaagatatttggtataccaatacttttcctggattgaaaactttttttaaactttttaaaatttgggccactctgtatgcatatgtttggtcttgttaaagaggaagaaaggatgtgtgttatactgtacctgtgaatgttgatacagttacaatttatttgacaaggttgtaattctagaatatgcttaataaaatgaaaactggccatgactacagccagaactgttatgagattaacatttctattgagaagcttttgagtaaagtactgtatttgttcatgaagatgactgagatggtaacacttcgtgtagcttaaggaaatgggcagaatttcgtaaatgctgttgtgcagatgtgttttccctgaatgctttcgtattagtggcgaccagtttctcacagaattgtgaagcctgaaggccaagaggaagtcactgttaaaggactctgtgccatcttacaaccttggatgaattatcctgccaacgtgaaaacctcatgttcaaagaacacttccctttagccgatgtaactgctggttttgtttttcatatgtgtttttcttacactcatttgaatgctttcaagcatttgtaaacttaaaaaatgtataaagggcaaaaagtctgaacccttgttttctgaaatctaatcagttatgtatggtttctgaagggtaattttattttggaataggtaaaggaaacctgtttgtttgtttttcctgagggctagatgcattttttttctcacactcttaatgacttttaacatttatactgagcatccatagatatattcctagaagtatgagaagaattattcttattgaccattaatgtcatgttcattttaatgtaatataattgagatgaaatgttctctggttggaacagatactctctttttttttcttgcaatctttaagaatacatagatctaaaattcattagcttgacccctcaaagtaacttttaagtaaagattaaagcttttcttctcagtgaatatatctgctagaaggaaatagctgggaagaatttaatgatcagggaaattcattatttctatatgtggaaactttttgcttcgaatattgtatctttttaaatctaaatgttcatatttttcctgaagaaaccactgtgtaaaaatcaaattttaattttgaatggaataatttcaaagaactatgaagatgatttgaagctctaatttatatagtcacctataaaatgttctttatatgtgttcataagtaaattttatattgattaagttaaacttttgaattgatttgaggagcagtaaaatgaaagctatatctattctaaaccttatttagacattggtaccagttacccaggtgaaaatatggagtaactttgttttgtatggtaaggtttaggaatggtggatgaagggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatatttattttaaccaaaatgttactcacattaaatgtttattctttaaaatgaatgtattatgtttttaacccacaaatgcatacttaccctgtgcctcatatttcaatagtactgtaatatggacatcttttgtgaaatacttttattttgttatgctttaaatatacatacaaaaagatttctgttattagctttgaaaattgtataatatcctaatataaacaaaaatataaaaataaaaatgaatacagtaaaa

SEQ ID NO: 68160 - DNA, 3178 bp, Homo sapiens
tttgtttttttgcagttggtacgccttattacatgtctccagagagaatacatgaaaatggatacaacttcaaatctgacatctggtctcttggctgtctactatatgagatggctgcattacaaagtcctttctatggtgacaaaatgaatttatactcactgtgtaagaagatagaacagtgtgactacccacctcttccttcagatcactattcagaagaactccgacagttagttaatatgtgcatcaacccagatccagagaagcgaccagacgtcacctatgtttatgacgtagcaaagaggatgcatgcatgcactgcaagcagctaaacatgcaagatcatgaagagtgtaaccaaagtaattgaaagtattttgtgcaagtcatacctccccatttatgtctggtgttaagattaatatttcagagctagtgtgctttgaatccttaaccagttttcatataagcttcattttgtaccagtcacctaaatcacctccttgcaacccccaaatgactttggaataactgaattgcatgttaggagagaaaatgaaacatgatggttttgaatggctaaaggtttatagaatttcttacagttttctgctgataaattgtgtttagatagactgtcagtgccaaatattgaaggtgcagcttggcacacatcagaatagactcatacctgagaaaaagtatctgaacatgtgacttgtttcttttttagtaatttatggacattgagatgaacacaattgtgaacttttgtgaagattttatttttaaacgtttgaagtactagttttagttcttagcagagtagttttcaaatatgattcttatgataaatgtagacacaaactatttgagaaacatttagaactcttagcttatacattcaaaatgtaactattaaatgtgaagatttggggacaaaatgtgagtcagacactgaagagttttttgttttgttttaatatttttgatattctctttgcattgaaatggtataaatgaatccatttaaaaagtggttaaggatttgtttagctggtgtgataataatttttaaagttgcacattgcccaaggctttttttgtgtgtttttattgttgtttgtacatttgaaaaatattctttgaataaccttgcagtactatatttcaatttctttataaatttaagtgcattttaactcataattgtacactataatataagcctaagtttttattcataagttttattgaagttctgatcggtccccttcagaaatttttttatattattcttcaagttactttcttatttatattgtatgtgcattttatccattaatgtttcatactttctgagagtataatacccttttaaaagatatttggtataccaatacttttcctggattgaaaactttttttaaactttttaaaatttgggccactctgtatgcatatgtttggtcttgttaaagaggaagaaaggatgtgtgttatactgtacctgtgaatgttgatacagttacaatttatttgacaaggttgtaattctagaatatgcttaataaaatgaaaactggccatgactacagccagaactgttatgagattaacatttctattgagaagcttttgagtaaagtactgtatttgttcatgaagatgactgagatggtaacacttcgtgtagcttaaggaaatgggcagaatttcgtaaatgctgttgtgcagatgtgttttccctgaatgctttcgtattagtggcgaccagtttctcacagaattgtgaagcctgaaggccaagaggaagtcactgttaaaggactctgtgccatcttacaaccttggatgaattatcctgccaacgtgaaaacctcatgttcaaagaacacttccctttagccgatgtaactgctggttttgtttttcatatgtgtttttcttacactcatttgaatgctttcaagcatttgtaaacttaaaaaatgtataaagggcaaaaagtctgaacccttgttttctgaaatctaatcagttatgtatggtttctgaagggtaattttattttggaataggtaaaggaaacctgtttgtttgtttttcctgagggctagatgcattttttttctcacactcttaatgacttttaacatttatactgagcatccatagatatattcctagaagtatgagaagaattattcttattgaccattaatgtcatgttcattttaatgtaatataattgagatgaaatgttctctggttggaacagatactctctttttttttcttgcaatctttaagaatacatagatctaaaattcattagcttgacccctcaaagtaacttttaagtaaagattaaagcttttcttctcagtgaatatatctgctagaaggaaatagctgggaagaatttaatgatcagggaaattcattatttctatatgtggaaactttttgcttcgaatattgtatctttttaaatctaaatgttcatatttttcctgaagaaaccactgtgtaaaaatcaaattttaattttgaatggaataatttcaaagaactatgaagatgatttgaagctctaatttatatagtcacctataaaatgttctttatatgtgttcataagtaaattttatattgattaagttaaacttttgaattgatttgaggagcagtaaaatgaaagctatatctattctaaaccttatttagacattggtaccagttacccaggtggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatatttattttaaccaaaatgttactcacattaaatgtttattctttaaaatgaatgtattatgtttttaacccacaaatgcatacttaccctgtgcctcatatttcaatagtactgtaatatggacatcttttgtgaaatacttttattttgttatgctttaaatatacatacaaaaagatttctgttattagctttgaaaattgtataatatcctaatataaacaaaaatataaaaataaaaatgaatacagtaaaa

SEQ ID NO: 68161 - DNA, 1163 bp, Homo sapiens
cttttggggtctttgctcttttggggtctttgctcttttggggtcttggctagatgcattttttttctcacactcttaatgacttttaacatttatactgagcatccatagatatattcctagaagtatgagaagaattattcttattgaccattaatgtcatgttcattttaatgtaatataattgagatgaaatgttctctggttggaacagatactctctttttttttcttgcaatctttaagaatacatagatctaaaattcattagcttgacccctcaaagtaacttttaagtaaagattaaagcttttcttctcagtgaatatatctgctagaaggaaatagctgggaagaatttaatgatcagggaaattcattatttctatatgtggaaactttttgcttcgaatattgtatctttttaaatctaaatgttcatatttttcctgaagaaaccactgtgtaaaaatcaaattttaattttgaatggaataatttcaaagaactatgaagatgatttgaagctctaatttatatagtcacctataaaatgttctttatatgtgttcataagtaaattttatattgattaagttaaacttttgaattgatttgaggagcagtaaaatgaaagctatatctattctaaaccttatttagacattggtaccagttacccaggtgaaaatatggagtaactttgttttgtatggtaaggtttaggaatggtggatgaagggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatatttattttaaccaaaatgttactcacattaaatgtttattctttaaaatgaatgtattatgtttttaacccacaaatgcatacttaccctgtgcctcatatttcaatagtactgtaatatggacatcttttgtgaaatacttttattttgttatgctttaaatatacatacaaaaagatttctgttattagctttgaaaattgtataatatcctaatataaacaaaaatataaaaataaaaatgaatacagtaaaa

SEQ ID NO: 68162 - DNA, 2509 bp, Homo sapiens
tttgtttttttgcagttggtacgccttattacatgtctccagagagaatacatgaaaatggatacaacttcaaatctgacatctggtctcttggctgtctactatatgagatggctgcattacaaagtcctttctatggtgacaaaatgaatttatactcactgtgtaagaagatagaacagtgtgactacccacctcttccttcagatcactattcagaagaactccgacagttagttaatatgtgcatcaacccagatccagagaagcgaccagacgtcacctatgtttatgacgtagcaaagaggatgcatgcatgcactgcaagcagctaaacatgcaagatcatgaagagtgtaaccaaagtaattgaaagtattttgtgcaagtcatacctccccatttatgtctggtgttaagattaatatttcagagctagtgtgctttgaatccttaaccagttttcatataagcttcattttgtaccagtcacctaaatcacctccttgcaacccccaaatgactttggaataactgaattgcatgttaggagagaaaatgaaacatgatggttttgaatggctaaaggtttatagaatttcttacagttttctgctgataaattgtgtttagatagactgtcagtgccaaatattgaaggtgcagcttggcacacatcagaatagactcatacctgagaaaaagtatctgaacatgtgacttgtttcttttttagtaatttatggacattgagatgaacacaattgtgaacttttgtgaagattttatttttaaacgtttgaagtactagttttagttcttagcagagtagttttcaaatatgattcttatgataaatgtagacacaaactatttgagaaacatttagaactcttagcttatacattcaaaatgtaactattaaatgtgaagatttggggacaaaatgtgagtcagacactgaagagttttttgttttgttttaatatttttgatattctctttgcattgaaatggtataaatgaatccatttaaaaagtggttaaggatttgtttagctggtgtgataataatttttaaagttgcacattgcccaaggctttttttgtgtgtttttattgttgtttgtacatttgaaaaatattctttgaataaccttgcagtactatatttcaatttctttataaatttaagtgcattttaactcataattgtacactataatataagcctaagtttttattcataagttttattgaagttctgatcggtccccttcagaaatttttttatattattcttcaagttactttcttatttatattgtatgtgcattttatccattaatgtttcatactttctgagagtataatacccttttaaaagatatttggtataccaatacttttcctggattgaaaactttttttaaactttttaaaatttgggccactctgtatgcatatgtttggtcttgttaaagaggaagaaaggatgtgtgttatactgtacctgtgaatgttgatacagttacaatttatttgacaaggttgtaattctagaatatgcttaataaaatgaaaactggccatgactacagccagaactgttatgagattaacatttctattgagaagcttttgagtaaagtactgtatttgttcatgaagatgactgagatggtaacacttcgtgtagcttaaggaaatgggcagaatttcgtaaatgctgttgtgcagatgtgttttccctgaatgctttcgtattagtggcgaccagtttctcacagaattgtgaagcctgaaggccaagaggaagtcactgttaaaggactctgtgccatcttacaaccttggatgaattatcctgccaacgtgaaaacctcatgttcaaagaacacttccctttagccgatgtaactgctggttttgtttttcatatgtgtttttcttacactcatttgaatgctttcaagcatttgtaaacttaaaaaatgtataaagggcaaaaagtctgaacccttgttttctgaaatctaatcagttatgtatggtttctgaagggtaattttattttggaataggtaaaggaaacctgtttgtttgtttttcctgagggctagatgcattttttttctcacactcagcactacctggagggcctgtgcgtggagtggctccgcagatacctggagaacgggaaggagacgctgcagcgcgcggaccccccaaagacacatgtgacccaccaccccatgtttgaccatgaggccaccctgaggcgctgggccctgggcttctaccctgcggagatcacactgacctggcatggggatgtgcaagaccaaactcaggacaccgagcttgtggagaccagaccagcaggagatagaacctttcagaaatgggcaactggggtggtgccttttgggagaaaaacacaaatacccatgccatgtccaaaatgaggggcttgtctaaagccccctaaaccttgagatggggaaac

SEQ ID NO: 68163 - DNA, 396 bp, Homo sapiens
gcgtcgcctagaggacccggtgtcgagtaagatattacagccatttcatgaatgctttaccattcaacatagtatctattacaaaacacctttcttgtatccatatacttcaggtgttgctgttaacatttactatgatatttattttaaccaaaatgttactcacattaaatgtttattctttaaaatgaatgtattatgtttttaacccacaaatgcatacttaccctgtgcctcatatttcaatagtactgtaatatggacatcttttgtgaaatacttttattttgttatgctttaaatatacatacaaaaagatttctgttattagctttgaaaattgtataatatcctaatataaacaaaaatataaaaataaaaatgaatacagtaaaa

SEQ ID NO: 68164 - DNA, 3233 bp, Homo sapiens
tttgtttttttgcagttggtacgccttattacatgtctccagagagaatacatgaaaatggatacaacttcaaatctgacatctggtctcttggctgtctactatatgagatggctgcattacaaagtcctttctatggtgacaaaatgaatttatactcactgtgtaagaagatagaacagtgtgactacccacctcttccttcagatcactattcagaagaactccgacagttagttaatatgtgcatcaacccagatccagagaagcgaccagacgtcacctatgtttatgacgtagcaaagaggatgcatgcatgcactgcaagcagctaaacatgcaagatcatgaagagtgtaaccaaagtaattgaaagtattttgtgcaagtcatacctccccatttatgtctggtgttaagattaatatttcagagctagtgtgctttgaatccttaaccagttttcatataagcttcattttgtaccagtcacctaaatcacctccttgcaacccccaaatgactttggaataactgaattgcatgttaggagagaaaatgaaacatgatggttttgaatggctaaaggtttatagaatttcttacagttttctgctgataaattgtgtttagatagactgtcagtgccaaatattgaaggtgcagcttggcacacatcagaatagactcatacctgagaaaaagtatctgaacatgtgacttgtttcttttttagtaatttatggacattgagatgaacacaattgtgaacttttgtgaagattttatttttaaacgtttgaagtactagttttagttcttagcagagtagttttcaaatatgattcttatgataaatgtagacacaaactatttgagaaacatttagaactcttagcttatacattcaaaatgtaactattaaatgtgaagatttggggacaaaatgtgagtcagacactgaagagttttttgttttgttttaatatttttgatattctctttgcattgaaatggtataaatgaatccatttaaaaagtggttaaggatttgtttagctggtgtgataataatttttaaagttgcacattgcccaaggctttttttgtgtgtttttattgttgtttgtacatttgaaaaatattctttgaataaccttgcagtactatatttcaatttctttataaatttaagtgcattttaactcataattgtacactataatataagcctaagtttttattcataagttttattgaagttctgatcggtccccttcagaaatttttttatattattcttcaagttactttcttatttatattgtatgtgcattttatccattaatgtttcatactttctgagagtataatacccttttaaaagatatttggtataccaatacttttcctggattgaaaactttttttaaactttttaaaatttgggccactctgtatgcatatgtttggtcttgttaaagaggaagaaaggatgtgtgttatactgtacctgtgaatgttgatacagttacaatttatttgacaaggttgtaattctagaatatgcttaataaaatgaaaactggccatgactacagccagaactgttatgagattaacatttctattgagaagcttttgagtaaagtactgtatttgttcatgaagatgactgagatggtaacacttcgtgtagcttaaggaaatgggcagaatttcgtaaatgctgttgtgcagatgtgttttccctgaatgctttcgtattagtggcgaccagtttctcacagaattgtgaagcctgaaggccaagaggaagtcactgttaaaggactctgtgccatcttacaaccttggatgaattatcctgccaacgtgaaaacctcatgttcaaagaacacttccctttagccgatgtaactgctggttttgtttttcatatgtgtttttcttacactcatttgaatgctttcaagcatttgtaaacttaaaaaatgtataaagggcaaaaagtctgaacccttgttttctgaaatctaatcagttatgtatggtttctgaagggtaattttattttggaataggtaaaggaaacctgtttgtttgtttttcctgagggctagatgcattttttttctcacactcttaatgacttttaacatttatactgagcatccatagatatattcctagaagtatgagaagaattattcttattgaccattaatgtcatgttcattttaatgtaatataattgagatgaaatgttctctggttggaacagatactctctttttttttcttgcaatctttaagaatacatagatctaaaattcattagcttgacccctcaaagtaacttttaagtaaagattaaagcttttcttctcagtgaatatatctgctagaaggaaatagctgggaagaatttaatgatcagggaaattcattatttctatatgtggaaactttttgcttcgaatattgtatctttttaaatctaaatgttcatatttttcctgaagaaaccactgtgtaaaaatcaaattttaattttgaatggaataatttcaaagaactatgaagatgatttgaagctctaatttatatagtcacctataaaatgttctttatatgtgttcataagtaaattttatattgattaagttaaacttttgaattgatttgaggagcagtaaaatgaaagctatatctattctaaaccttatttagacattggtaccagttacccaggtgaaaatatggagtaactttgttttgtatggtaaggtttaggaatggtggatgaagggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatatttattttaaccaaaatgttactcacattaaatgtttattctttaaaatgaatgtattatgtttttaacccacaaatgcatacttaccctgtgcctcatatttcaatagtactgtaatatggacatcttttgtgaaatacttttattttgttatgctttaaatatacatacaaaaagatttctgttattagctttgaaaattgtataatatcctaatataaacaaaaatataaaaataaaaatgaatacagtaaaa

SEQ ID NO: 68165 - DNA, 3341 bp, Homo sapiens
tttgtttttttgcagttggtacgccttattacatgtctccagagagaatacatgaaaatggatacaacttcaaatctgacatctggtctcttggctgtctactatatgagatggctgcattacaaagtcctttctatggtgacaaaatgaatttatactcactgtgtaagaagatagaacagtgtgactacccacctcttccttcagatcactattcagaagaactccgacagttagttaatatgtgcatcaacccagatccagagaagcgaccagacgtcacctatgtttatgacgtagcaaagaggatgcatgcatgcactgcaagcagctaaacatgcaagatcatgaagagtgtaaccaaagtaattgaaagtattttgtgcaagtcatacctccccatttatgtctggtgttaagattaatatttcagagctagtgtgctttgaatccttaaccagttttcatataagcttcattttgtaccagtcacctaaatcacctccttgcaacccccaaatgactttggaataactgaattgcatgttaggagagaaaatgaaacatgatggttttgaatggctaaaggtttatagaatttcttacagttttctgctgataaattgtgtttagatagactgtcagtgccaaatattgaaggtgcagcttggcacacatcagaatagactcatacctgagaaaaagtatctgaacatgtgacttgtttcttttttagtaatttatggacattgagatgaacacaattgtgaacttttgtgaagattttatttttaaacgtttgaagtactagttttagttcttagcagagtagttttcaaatatgattcttatgataaatgtagacacaaactatttgagaaacatttagaactcttagcttatacattcaaaatgtaactattaaatgtgaagatttggggacaaaatgtgagtcagacactgaagagttttttgttttgttttaatatttttgatattctctttgcattgaaatggtataaatgaatccatttaaaaagtggttaaggatttgtttagctggtgtgataataatttttaaagttgcacattgcccaaggctttttttgtgtgtttttattgttgtttgtacatttgaaaaatattctttgaataaccttgcagtactatatttcaatttctttataaatttaagtgcattttaactcataattgtacactataatataagcctaagtttttattcataagttttattgaagttctgatcggtccccttcagaaatttttttatattattcttcaagttactttcttatttatattgtatgtgcattttatccattaatgtttcatactttctgagagtataatacccttttaaaagatatttggtataccaatacttttcctggattgaaaactttttttaaactttttaaaatttgggccactctgtatgcatatgtttggtcttgttaaagaggaagaaaggatgtgtgttatactgtacctgtgaatgttgatacagttacaatttatttgacaaggttgtaattctagaatatgcttaataaaatgaaaactggccatgactacagccagaactgttatgagattaacatttctattgagaagcttttgagtaaagtactgtatttgttcatgaagatgactgagatggtaacacttcgtgtagcttaaggaaatgggcagaatttcgtaaatgctgttgtgcagatgtgttttccctgaatgctttcgtattagtggcgaccagtttctcacagaattgtgaagcctgaaggccaagaggaagtcactgttaaaggactctgtgccatcttacaaccttggatgaattatcctgccaacgtgaaaacctcatgttcaaagaacacttccctttagccgatgtaactgctggttttgtttttcatatgtgtttttcttacactcatttgaatgctttcaagcatttgtaaacttaaaaaatgtataaagggcaaaaagtctgaacccttgttttctgaaatctaatcagttatgtatggtttctgaagggtaattttattttggaataggtaaaggaaacctgtttgtttgtttttcctgagggctagatgcattttttttctcacactcttaatgacttttaacatttatactgagcatccatagatatattcctagaagtatgagaagaattattcttattgaccattaatgtcatgttcattttaatgtaatataattgagatgaaatgttctctggttggaacagatactctctttttttttcttgcaatctttaagaatacatagatctaaaattcattagcttgacccctcaaagtaacttttaagtaaagattaaagcttttcttctcagtgaatatatctgctagaaggaaatagctgggaagaatttaatgatcagggaaattcattatttctatatgtggaaactttttgcttcgaatattgtatctttttaaatctaaatgttcatatttttcctgaagaaaccactgtgtaaaaatcaaattttaattttgaatggaataatttcaaagaactatgaagatgatttgaagctctaatttatatagtcacctataaaatgttctttatatgtgttcataagtaaattttatattgattaagttaaacttttgaattgatttgaggagcagtaaaatgaaagctatatctattctaaaccttatttagacattggtaccagttacccaggtgaaaatatggagtaactttgttttgtatggtaaggtttaggaatggtggatgaagggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatatttattttaaccaaaatgttactcacattaaatgtttattctttaaaatgaatgtattatgtttttaacccacaaatgcatacttaccctgtgcctcatatttcaatagtactgtaatatggacatcttttgtgaaatacttttattttgttatgctttaaatatacatacaaaaagatttctgttattagctttgaaaattgtataatatcctaatataaacaaaaatataaaaataaaaatgaatacagtaaaaaaaaaaaaagaaaacgaaaaaattgttgtggcggcctggcctggaaaggtttttaaaacacacgggtgggggggcgggcccaggtggttagggaagggggcaaaacgg

SEQ ID NO: 68166 - DNA, 3026 bp, Homo sapiens
tttgtttttttgcagttggtacgccttattacatgtctccagagagaatacatgaaaatggatacaacttcaaatctgacatctggtctcttggctgtctactatatgagatggctgcattacaaagtcctttctatggtgacaaaatgaatttatactcactgtgtaagaagatagaacagtgtgactacccacctcttccttcagatcactattcagaagaactccgacagttagttaatatgtgcatcaacccagatccagagaagcgaccagacgtcacctatgtttatgacgtagcaaagaggatgcatgcatgcactgcaagcagctaaacatgcaagatcatgaagagtgtaaccaaagtaattgaaagtattttgtgcaagtcatacctccccatttatgtctggtgttaagattaatatttcagagctagtgtgctttgaatccttaaccagttttcatataagcttcattttgtaccagtcacctaaatcacctccttgcaacccccaaatgactttggaataactgaattgcatgttaggagagaaaatgaaacatgatggttttgaatggctaaaggtttatagaatttcttacagttttctgctgataaattgtgtttagatagactgtcagtgccaaatattgaaggtgcagcttggcacacatcagaatagactcatacctgagaaaaagtatctgaacatgtgacttgtttcttttttagtaatttatggacattgagatgaacacaattgtgaacttttgtgaagattttatttttaaacgtttgaagtactagttttagttcttagcagagtagttttcaaatatgattcttatgataaatgtagacacaaactatttgagaaacatttagaactcttagcttatacattcaaaatgtaactattaaatgtgaagatttggggacaaaatgtgagtcagacactgaagagttttttgttttgttttaatatttttgatattctctttgcattgaaatggtataaatgaatccatttaaaaagtggttaaggatttgtttagctggtgtgataataatttttaaagttgcacattgcccaaggctttttttgtgtgtttttattgttgtttgtacatttgaaaaatattctttgaataaccttgcagtactatatttcaatttctttataaatttaagtgcattttaactcataattgtacactataatataagcctaagtttttattcataagttttattgaagttctgatcggtccccttcagaaatttttttatattattcttcaagttactttcttatttatattgtatgtgcattttatccattaatgtttcatactttctgagagtataatacccttttaaaagatatttggtataccaatacttttcctggattgaaaactttttttaaactttttaaaatttgggccactctgtatgcatatgtttggtcttgttaaagaggaagaaaggatgtgtgttatactgtacctgtgaatgttgatacagttacaatttatttgacaaggttgtaattctagaatatgcttaataaaatgaaaactggccatgactacagccagaactgttatgagattaacatttctattgagaagcttttgagtaaagtactgtatttgttcatgaagatgactgagatggtaacacttcgtgtagcttaaggaaatgggcagaatttcgtaaatgctgttgtgcagatgtgttttccctgaatgctttcgtattagtggcgaccagtttctcacagaattgtgaagcctgaaggccaagaggaagtcactgttaaaggactctgtgccatcttacaaccttggatgaattatcctgccaacgtgaaaacctcatgttcaaagaacacttccctttagccgatgtaactgctggttttgtttttcatatgtgtttttcttacactcatttgaatgctttcaagcatttgtaaacttaaaaaatgtataaagggcaaaaagtctgaacccttgttttctgaaatctaatcagttatgtatggtttctgaagggtaattttattttggaataggtaaaggaaacctgtttgtttgtttttcctgagggctagatgcattttttttctcacactcttaatgacttttaacatttatactgagcatccatagatatattcctagaagtatgagaagaattattcttattgaccattaatgtcatgttcattttaatgtaatataattgagatgaaatgttctctggttggaacagatactctctttttttttcttgcaatctttaagaatacatagatctaaaattcattagcttgacccctcaaagtaacttttaagtaaagattaaagcttttcttctcagtgaatatatctgctagaaggaaatagctgggaagaatttaatgatcagggaaattcattatttctatatgtggaaactttttgcttcgaatattgtatctttttaaatctaaatgttcatatttttcctgaagaaaccactgtgtaaaaatcaaattttaattttgaatggaataatttcaaagaactatgaagatgatttgaagctctaatttatatagtcacctataaaatgttctttatatgtgttcataagtaaattttatattgattaagttaaacttttgaattgatttgaggagcagtaaaatgaaagctatatctattctaaaccttatttagacattggtaccagttacccaggtgaaaatatggagtaactttgttttgtatggtaaggtttaggaatggtggatgaagggtatctctatataaataaagtgctcaacaatgtgcaatgattgtaaatttagtaagatattacagccatttcatgaatgctttaccattcaacatagtatctattacaaaacacctttcttgtatccatatacttcaggtgttgctgttaacatttactatgatatttattttaaccaaaatgttactttgacgcggggatcgtctataggaaa

SEQ ID NO: 68167 - DNA, 2125 bp, Homo sapiens
tttgtttttttgcagttggtacgccttattacatgtctccagagagaatacatgaaaatggatacaacttcaaatctgacatctggtctcttggctgtctactatatgagatggctgcattacaaagtcctttctatggtgacaaaatgaatttatactcactgtgtaagaagatagaacagtgtgactacccacctcttccttcagatcactattcagaagaactccgacagttagttaatatgtgcatcaacccagatccagagaagcgaccagacgtcacctatgtttatgacgtagcaaagaggatgcatgcatgcactgcaagcagctaaacatgcaagatcatgaagagtgtaaccaaagtaattgaaagtattttgtgcaagtcatacctccccatttatgtctggtgttaagattaatatttcagagctagtgtgctttgaatccttaaccagttttcatataagcttcattttgtaccagtcacctaaatcacctccttgcaacccccaaatgactttggaataactgaattgcatgttaggagagaaaatgaaacatgatggttttgaatggctaaaggtttatagaatttcttacagttttctgctgataaattgtgtttagatagactgtcagtgccaaatattgaaggtgcagcttggcacacatcagaatagactcatacctgagaaaaagtatctgaacatgtgacttgtttcttttttagtaatttatggacattgagatgaacacaattgtgaacttttgtgaagattttatttttaaacgtttgaagtactagttttagttcttagcagagtagttttcaaatatgattcttatgataaatgtagacacaaactatttgagaaacatttagaactcttagcttatacattcaaaatgtaactattaaatgtgaagatttggggacaaaatgtgagtcagacactgaagagttttttgttttgttttaatatttttgatattctctttgcattgaaatggtataaatgaatccatttaaaaagtggttaaggatttgtttagctggtgtgataataatttttaaagttgcacattgcccaaggctttttttgtgtgtttttattgttgtttgtacatttgaaaaatattctttgaataaccttgcagtactatatttcaatttctttataaatttaagtgcattttaactcataattgtacactataatataagcctaagtttttattcataagttttattgaagttctgatcggtccccttcagaaatttttttatattattcttcaagttactttcttatttatattgtatgtgcattttatccattaatgtttcatactttctgagagtataatacccttttaaaagatatttggtataccaatacttttcctggattgaaaactttttttaaactttttaaaatttgggccactctgtatgcatatgtttggtcttgttaaagaggaagaaaggatgtgtgttatactgtacctgtgaatgttgatacagttacaatttatttgacaaggttgtaattctagaatatgcttaataaaatgaaaactggccatgactacagccagaactgttatgagattaacatttctattgagaagcttttgagtaaagtactgtatttgttcatgaagatgactgagatggtaacacttcgtgtagcttaaggaaatgggcagaatttcgtaaatgctgttgtgcagatgtgttttccctgaatgctttcgtattagtggcgaccagtttctcacagaattgtgaagcctgaaggccaagaggaagtcactgttaaaggactctgtgccatcttacaaccttggatgaattatcctgccaacgtgaaaacctcatgttcaaagaacacttccctttagccgatgtaactgctggttttgtttttcatatgtgtttttcttacactcatttgaatgctttcaagcatttgtaaacttaaaaaatgtataaagggcaaaaagtctgaacccttgttttctgaaatctaatcagttatgtatggtttctgaagggtaattttattttagccgatgtaactgctggttttgtttttcatatgtgtttttcttacac

SEQ ID NO: 68168 - DNA, 2352 bp, Homo sapiens
aatataactatttattttcctagtgtagatgctttcagattagaattggcatttgcactgatttttttatgtagatttatataaatatatagatacatatatatttgcttgaagaatcaccaagcaaattggtgagagggtcttttccaatagaatttacacctccatttgttgtgttgtcttgcacttcccaatgttgatgtctctatggctccaatgaactggtgtattttgcagcaaatctgatgacttgtatggaaatggcatgaaagttacccagattacatctggtgcaaatgcactcggagcctggggccagactggtgctaacactgcaaactttgtccagagctctctccaacctgaaggcttgctgggggtgcaatgtcaccttcacacatgctgggccctttcagaaaagtgccagatcgtgtaactggtgctatttttcatgctctggtacaatgtgtagcaccacgggggtctcagctttaccaaaatcaaaattccatttgtcagctaagtgcagaggcatttgttttttgctctcctcccacagaattgtcggccatttatttgcaggccttttgcgggatttcttggctatttatttgcaggccttttttcccagccccaaattcttgggttggctctgtctgcttaaagagcctgtcttcacaaagctgcactcgggtgcctctgtgcgctgtcttagatcctactgccggcccttcaggactccgagccaggaaagaactctccaacctctggctcgagactctactttttttctcattcttttccttactctcctcctccttctacttccgactaattccatctcttttttttttttgttcctctccttttcctattcctccttcccaccatctctgagttgttgactttctcctataatccttctctattccctttctctttttgtccacctctcctttagtctctgtttctctgcccttcttattcctcttctgtcctttctcctctcctcaaatctctgatcatcttctcccgtacatccctgtattgatttttctgtcctctaaagggctcatggctgattcagacagcaagtccatgcactggactaatgacacaaatactttaggtcgccgtttcacctactcagcccagaaagtaaagctgagcgtgaggccctgacctggagcctgctccagcccgcctcccggagccagcctgcaccgttgccctggcagcgatgatgcatgtgctgtgggccctgccggcgcctgagtgcctctgcctgaacactgctcctaagcgagcccactcccagcactaccgcatggctctgaggacattttctttcaataaaggcagactctggccccaattattctgatagcaaacctcttcctcctcattgaagccatgccatcaccttggtttggagagagacatttttttcccattcataagctttctttttcccatttttatgtgaagccccctctgcttttcagctggtgattgctctggtgagactgaatgggacttgctggtgaaatgaaatctcttctttcctgtcttggtcctgcctaaattcctacaaatatatttaagccaaggactcaggctaattcctaagttgatcacattaatttgttactcctagagggaaaaagatcaattcccttgaagcatgtggagtacctcctgtgacagctgacttgccaggggactccctacagaattctgtgatatacattttacttctgtgtatgtatggtatatatggtatgtataccatgtacacacgttacattgagtatgaatgactgtggttggaaacacacacacacactcaagtctgtaaatatccttcctcactgaaacctgtgctttggaaatcatttcttgtacagctgtgcagtttcttgtaacagctgaggacaaagctaagacaggcggacaatttagacaaagatcatctaaagagtatagtatctccctagcaactcatgaggacagacaaccaagtggcaaggttgactcccaatgggatggcagacttttcttctctcctttttgagtttgtgtttcctaagtgtttcttaacttctgagtgcaccaggctgtacccgttagatcctttcaatatgacagttttgtgcttctctctgacaggatgtttctccaccgagctgtagcacaggatgggagggaggtgggaatactccttgcctaggctggagtttacagagacactgcacagcttacactcctgttaagtgtaaatattcaacacttccattccatttgtgtaaaaaataaagcacacacgattataaaatcaagatgtatatttca

SEQ ID NO: 68169 - DNA, 2498 bp, Homo sapiens
aatataactatttattttcctagtgtagatgctttcagattagaattggcatttgcactgatttttttatgtagatttatataaatatatagatacatatatatttgcttgaagaatcaccaagcaaattggtgagagggtcttttccaatagaatttacacctccatttgttgtgttgtcttgcacttcccaatgttgatgtctctatggctccaatgaactggtgtattttgcagcaaatctgatgacttgtatggaaatggcatgaaagttacccagattacatctggtgcaaatgcactcggagcctggggccagactggtgctaacactgcaaactttgtccagagctctctccaacctgaaggcttgctgggggtgcaatgtcaccttcacacatgctgggccctttcagaaaagtgccagatcgtgtaactggtgctatttttcatgctctggtacaatgtgtagcaccacgggggtctcagctttaccaaaatcaaaattccatttgtcagctaagtgcagaggcatttgttttttgctctcctcccacagaattgtcggccatttatttgcaggccttttgcgggatttcttggctatttatttgcaggccttttttcccagccccaaattcttgggttggctctgtctgcttaaagagcctgtcttcacaaagctgcactcgggtgcctctgtgcgctgtcttagatcctactgccggcccttcaggactccgagccaggaaagaactctccaacctctggctcgagactctactttttttctcattcttttccttactctcctcctccttctacttccgactaattccatctcttttttttttttgttcctctccttttcctattcctccttcccaccatctctgagttgttgactttctcctataatccttctctattccctttctctttttgtccacctctcctttagtctctgtttctctgcccttcttattcctcttctgtcctttctcctctcctcaaatctctgatcatcttctcccgtacatccctgtattgatttttctgtcctctaaagggctcatggctgattcagacagcaagtccatgcactggactaatgacacaaatactttaggtcgccgtttcacctactcagcccagaaagtaaagctgagcgtgaggccctgacctggagcctgctccagcccgcctcccggagccagcctgcaccgttgccctggcagcgatgatgcatgtgctgtgggccctgccggcgcctgagtgcctctgcctgaacactgctcctaagcgagcccactcccagcactaccgcatggctctgaggacattttctttcaataaaggcagactctggccccaattattctgatagcaaacctcttcctcctcattgaagccatgccatcaccttggtttggagagagacatttttttcccattcataagctttctttttcccatttttatgtgaagccccctctgcttttcagctggtgattgctctggtgagactgaatgggacttgctggtgaaatgaaatctcttctttcctgtcttggtcctgcctaaattcctacaaatatatttaagccaaggactcaggctaattcctaagttgatcacattaatttgttactcctagagggaaaaagatcaattcccttgaagcatgtggagtacctcctgtgacagctgacttgccaggggactccctacagaattctgtgatatacattttacttctgtgtatgtatggtatatatggtatgtataccatgtacacacgttacattgagtatgaatgactgtggttggaaacacacacacacactcaagtctgtaaatatccttcctcactgaaacctgtgctttggaaatcatttcttgtacagctgtgcagtttcttgtaacagctgaggacaaagctaagacaggcggacaatttagacaaagatcatctaaagagtatagtatctccctagcaactcatgaggacagacaaccaagtggcaaggttgactcccaatgggatggcagacttttcttctctcctttttgagtttgtgtttcctaagtgtttcttaacttctgagtgcaccaggctgtacccgttagatcctttcaatatgacagttttgtgcttctctctgacaggatgtttctccaccgagctgtagcacaggatgggagggaggtgggaatactccttgcctaggctggagtttacagagacactgcacagcttacactcctgttaagtgtaaatattcaacacttccattccatttgtgtaaaaaataaagcacacacgattataaaatcaagatgtatatttcatactcagtgtgtctgtgcatatttattgcgtttctagttgtcagcggtgggtggccccattgtaaaaatgcctgatagagtgtttataaacatgtcatggttttattataagatataaatattaaaacattttatactttatggca

SEQ ID NO: 68170 - DNA, 353 bp, Homo sapiens
ctcggtacccctcggctctaccttgtctctcggctctaccttgtctctcggctctaccttgtctcccgtacatccctgtattgatttttctgtcctctaaagggctcatggctgattcagacaaggtagagccgagctcggctctaccttgtctaccagcaatcgtactagacatgagaaggcctctggtgatggaaggaaggggatcaggaagccctcccatgccagtgtgtgcttggtttcagcatcactccccatatttccttaaacagctaaatcccaccatcccaccttcgcaaccaatctccatacttgaactttttctgttattaaatcgtgctgtatctgtgaat

SEQ ID NO: 68171 - DNA, 341 bp, Homo sapiens
tcactgttaattaactgttgatacacttaaaacagcttggttggcaatgtcctttttgaataaagaagagccaggtgtgtttttcaggatgaactagacaatgctgtcacaagtttacctctacatcttattgccttggaaaaatttcctgcatatcgtggcacaagatggttggctctccaggcagcagttggcgttgtgaatcagtcatctcagcatgtgtctccaagatcccacagcagggggaaaaagaggtggagggtcacatgcctggtgttacatactttgaggcagaggtggtaggtgccatttctgctcacagctcatggaccagaacaaag

SEQ ID NO: 68172 - DNA, 406 bp, Homo sapiens
cctcaaagcagaggtaaacagaggtgggaaattcccactgccaacctcactttccccactcctgggtggcagccaactgcctccatcataccaggcttcgcgcagttcccttccacgccctgtagttctgtgagtgcaggccccaacatgagcggctcccctctgcctggcacacccggtctgcctgacaaacacctactcctcctggcaggctctcccttcctgtgggtaactctcctaagcctccccaagaggcctgacaccattcctccccccaccgcattcaccacctctggtggttcatctctgcactctagcctcactgcctgtgtctcctgggagaacacaagctcctcgagggcagaggctgtacttcactcatcgccccagccatagcatagttccc

SEQ ID NO: 68173 - DNA, 295 bp, Homo sapiens
tgcactcctgatctttatatgtctcttctaaatgttaagcctctgggagagagaatttgccccagactgaggcaggcatctgccccctttatccaatctgcttgagggcagggctgttagtacctagtgtagacattttggcccatccgaggaatcactgtgagctaggtggacaccccaagaaatggcccttacatgaggtaaatactgatagctggccgactacaggcagcacagcctcactaactcatggaaacagctcagaaagcatggggcggtttccgtaattctggtt

SEQ ID NO: 68174 - DNA, 435 bp, Homo sapiens
tgttaaagtaacttggcttcccaggactggaattatcatggagcagttagaattttgagagtaattacaacaggatcacattctgaaagagtcacattttgtcaaaaatctgaaaagtatgcaatttgtacaactcttactttctatgtgataagaatgcaatatgtgcctctttcccctactagccccatgtgacacatatttttcacactatgtggcatcaaccagtgccattacctcctgtggcaccatagagcccaatctcagggcagacattgccaaggtaaagaatgcactccatgtttataccaaattgcacaaagtatagacattgaggttaatggagatttaagcacaatcctagcaagtaagttttaagaatactgaatattatacattattgtaacatgaacctaaaattaatttaacagggcc

SEQ ID NO: 68175 - DNA, 416 bp, Homo sapiens
cagggttcttgcaaaaaagagatggtactctcaaactaggtaatctagaagagttttaaagagataatttgcagaggacagggaagttcttaggacaaacaggagaggactacctggccatatagggagaactgtggtccttagagaaaggataaaaccaaaccaggataacctggtacggagtgagatgaaggaataaacacccagatcttattctcctgctattctcagggggaatctggggaggcaaatagaagatatccagaaaatcacttttctagaatttacaactaaagatatatgactctacttaaatgttttctttatgtaagaagaaattattcacattcaaaaaacagtgattttaaaaaatgaatttggctgaacttaagctaccaaggaagactgaaagtgtt

SEQ ID NO: 68176 - DNA, 839 bp, Homo sapiens
  misc_feature (105)..(105): n is a, c, g, or t
ctgggacccgtttcccttgtgcatgatgttatttaagatttcccctcacttgctcccagagttcttggtctaacgtgccttcttctgggaaccatgggttattgnaaacaacagtttgcattaggccccttaactgagcctccgagacccaggctctgctagctttaagcagctgtttcaatacttacatatagtgttgctgttgagctgataactgttgtcccatgatgaaaccctaggttgaaaattccctcaaacttggaaatcctgagtgggcaccaattacttacttcccgcacagtctcttcacctcatttttgggggttccatcgtgatctgttgcagcattcctcacacagggcaccagttgctgggtctgtcccacagaccctggctggacgatggatgaaacgagtactcagacgcagatatgcagtgtaagagcagctaggggactgcttggcactagcggccaaagagtgagcaggcaaacagctggagctgcttgcttttattcagtatagacataatgctgaaagcctggagcaaaaacaatctgtgggtaattaacattattgttcccctttcagggaacgggtcacgcatgtggatgatcaaaggtcagctcctggtcaatatgagaagactggtttcagaaaagttgagtgctgaagactacaaagctgtttgtaagttatcaagctaggatttgatcccaggtctgcctgataaatcctggactcttaaccatgacataggagtgccctcttgactcctatgatggcataaagaattgtatcagaacgggtaatctggcattaaaacccctgtgccacaac

SEQ ID NO: 68177 - DNA, 761 bp, Homo sapiens
gctttctgctgccccaggaatgggctgatttcctgagtacacattaatctgagctccctcagattggggattgggggcacaagatgggtggagccagatagggaagattcccccagtgttgtcctgctcccagtccaggtttgggacaatgccggcagcgtttccctgtgtctttcccccacaaagtctccaagtctttcctcaaatgatcgtcaaggtttgggagaaacaatctcttcctctgcccgggttgcgtggatctccagtggaaaggctttatctaccaagaaatgaattggataatccacataaacaaaaagcttggaaaatttatccaccagaatttgccgtggagatactttttggtatggtttctgtggattctctgctctttgtgctctcctccccacattggtggctccatctggcacagggaagcttctggatgtcagaaggtggattctcactctgtcacccaggctggagtgtagtggcacaatctttgctcacttcaacctctgccttctgcgttcgagcaattctcctgcctcagcctcccgagtaactgggattacagggacagtaagtggtgtttcctgggagatgctacggtgttatttttgcactacaagggctctgaagactgccaggcttgaagtgaagaaccacgtcacctgcctatcccagccaggtgacagtggacaaggggcttcacctctgagctgttttccagctgtactgggcacattcctcctctcacc

SEQ ID NO: 68178 - DNA, 718 bp, Homo sapiens
gctttctgctgccccaggaatgggctgatttcctgagtacacattaatctgagctccctcagattggggattgggggcacaagatgggtggagccagatagggaagattcccccagtgttgtcctgctcccagtccaggtttgggacaatgccggcagcgtttccctgtgtctttcccccacaaagtctccaagtctttcctcaaatgatcgtcaaggtttgggagaaacaatctcttcctctgcccgggttgcgtggatctccagtggaaaggaagaaccggaactatggtttgtgcctgccttattgcctccaaaatatttttaactgcagaggctttatctaccaagaaatgaattggataatccacataaacaaaaagcttggaaaatttatccaccagaatttgccgtggagatactttttggaacctggcttaccagtatatcaccccagcgttgacacactgggaacgggtcacgcatgtggatgatcaaaggtcagctcctggtcaatatgagaagactggtttcagaaaagttgagtgctgaagactacaaagctgtttgtaagttatcaagctaggatttgatcccaggtctgcctgataaatcctggactcttaaccatgacataggagtgccctcttgactcctatgatggcataaagaattgtatcagaacgggtaatctggcattaaaacccctgtgccacaac

SEQ ID NO: 68179 - DNA, 385 bp, Homo sapiens
gtgcagccagatttgaaaaacatttcatagaatattcttttcagaaacttgactgaaaatgaaaggtgaggatttagggtagtttctactcggaggtggaaattgtgagagaaaataagagacttgactgtaagaactatgacagagccactgtgtctaaacattagttgaaaatacttgagatcagaattcaggttatggtagaaatgaaagtatagaaatcaaagtcactggtagaaaaatcccctctaaaaagagaatggtgaaaagctcatcctgtgggcctatagaaaaagatgtgaaaatgagtaaaattctaattcgattgcttttctttttatttgttatataaagagatacagacaagacattgaaggaatcttac

SEQ ID NO: 68180 - DNA, 245 bp, Homo sapiens
tatatacattattctccccacctcgtccgaacgcccgtcaaaaagttagctaggcatggacattcacttttgcagatgaggaaacaagaattcagagttgatttgcacatacgaagcaaaacaagtgagatccaagcctccagactctacaacagatgcttccaatatctatgtctaatgaagtaaactactctgaaaatcaaaatgtgtattttttaaattaataaaaactttctttctacctc

SEQ ID NO: 68181 - DNA, 243 bp, Homo sapiens
atataagtaatttcaattaaagagcaagggccggagcgagggtgtcactaggcatggacattcacttttgcagatgaggaaacaagaattcagagttgatttgcacatacgaagcaaaacaagtgagatccaagcctccagactctacaacagatgcttccaatatctatgtctaatgaagtaaactactctgaaaatcaaaatgtgtattttttaaattaataaaaactttctttctacctc

SEQ ID NO: 68182 - DNA, 241 bp, Homo sapiens
accaccactaaccacagagacatgtaatgataaaaatttctgttgctaggcatggacattcacttttgcagatgaggaaacaagaattcagagttgatttgcacatacgaagcaaaacaagtgagatccaagcctccagactctacaacagatgcttccaatatctatgtctaatgaagtaaactactctgaaaatcaaaatgtgtattttttaaattaataaaaactttctttctacctc

SEQ ID NO: 68183 - DNA, 500 bp, Homo sapiens
tgagcagcgtgcccatgcctgagcccgtgccgccgcccagcgagtgcgtgagctggaagccctgcaggcagtcgcagtgctcgcactccttccgcaccacgtcacagcactgcgtccaccacgtccgcgccctccgtgtagtgccctttcgcccagttgttccctgcacccgtctggcctgcaacaaagagagtcccgtgccgtttaaacaggaaagcgtgcgccatcaccatgcttggtcaccgacaaggagggtgtgaagtgattccatgatgtgctgttagccaaagggaggggccggggaaacaggcacccaccaacggtgcagctgagcagatgcactgctaggcatggacattcacttttgcagatgaggaaacaagaattcagagttgatttgcacatacgaagcaaaacaagtgagatccaagcctccagactctacaacagatgcttccaatatctatgtctaatgaagtaaactactctgaaaatcaaaa

SEQ ID NO: 68184 - DNA, 949 bp, Homo sapiens
  misc_feature (619)..(619): n is a, c, g, or t
  misc_feature (769)..(769): n is a, c, g, or t
  misc_feature (867)..(867): n is a, c, g, or t
ggcaacataacaatcacaattcatcataatctaccacaatcccagttagcgaggacaaccacttttgtttatgagaacaccggaaacaagaattcagagttgatttgcacatacgaagcaaaacaagtgagatccaagcctccagactctacaacagatgcttccaatatctatgtctaatgaagtaaactactctgaaaatcaaaacgggcccttttcaaacccaaccccccccttccctctacctgtaaacaaaacaaaaaatggcctcattgcccccatttggtggacctcttgcggacgctacccccttaactgaggcagaatccacccacccccccatccactcactggcctttatcacgccccgcgccccccaccgcgccccacacgacacccccccctccactccccgctactccgggttaagccccacaaaacactccccatgcaccggcatgccagatccgcccccgccccgcccggcccccgttcctccccctcccttattgtcacccacagctcccctccccaccatcccaccccctactcaattccacccacgtgcgagagttatgtcaccccccggacgcttccctcgccctcaccgtcacagtcngcaccccagcaccgcaccccccccgccctcccgccaccattcccactccctctgccctcccccctccatcgacggacacgctacccaccaaaccccaaacaggcagggctatgatatcggccaaagcaagccatccgcaagtattgtggnccctgagacgtgcccagatacattaccccacaccctcccgccacgcgccaagtatgcgcttcatcagttcctctcattcgtccgcacacccccgccantcccctctccacaagctttcataccacgaacaattgcgatcccgtctacaaagagtccagccgccccatcgcccatcgatgg

SEQ ID NO: 68185 - DNA, 224 bp, Homo sapiens
  misc_feature (58)..(58): n is a, c, g, or t
gcacacctaacgtccccatgccaggggaaggaggcctgtggtgactaccccttgctgnggaaacaagaattcagagttgatttgcacatacgaagcaaaacaagtgagatccaagcctccagactctacaacagatgcttccaatatctatgtctaatgaagtaaactactctgaaaatcaaaatgtgtattttttaaattaataaaaactttctttctacctc

SEQ ID NO: 68186 - DNA, 194 bp, Homo sapiens
tccttcactccctacacatacactcaatcagacccacaaacacgtttagcaggccataacttttgttcggaaacaagaattcagagttgatttgcacatacgaagcaaaacaagtgagatccaagcctccagactctacaacagatgcttccaatatctatgtctaatgaagtaaactactctgaaaatcaaaa

SEQ ID NO: 68187 - DNA, 962 bp, Homo sapiens
ctaatattaagagagcaaaatagttgatgattagtttattagtatctcaaaataatccatttgatgtgctaaggtgctattagttacaacatttcaagtatacatgcaattcttgttagaaatattatccaccttttgaaatacatgttgattaaagactaacatgggctgtgggcataggtacagtaacagcataccataggccggagaaagagttgactttggaggtccaagatcaagaagcaggatgtctaacagggctcttgagaattctagggcagccggtactcgaaaggcaagatttgattgtgaatgatttcatgcaactccgttggttaataagcaaatcctgcccacacttgtggataacatggaagctacctgagcaggtaaaggctaagacagaagatccatgaacagaactggagttttgataattcaccaggaacttggttactttgttgtaccttttatgcttttatatttcttcttccctttcatttccatgcaacgtatttataacttgtagctagatttttagattactgccagacaaattcagtcaatttaattaattaggcaaattaaagtgaaaattatgttttaggggctgttaaaatttataagacgttagcacattcttctcatgtgcttttattattattacaaatgttgtttcataattagccatgtgttaattgttagcttggggaatgatttacgtgtttaaaattgggagaaatcattttggctatggctacctcttttaatttacttacatatttttttcccatcacacagtgtttgacttttacaaccacataaattttgattagaacctgaaataattcagtaaaacaagatgatggttttttgttctgctcaatctttgtatcataaccttcacttctcaatgctcaaatgatggaatgaaaagtggacaattcttgactgcatcgtgc

SEQ ID NO: 68188 - DNA, 205 bp, Homo sapiens
aagccactctgatatcagtcagttctgagattccttatttgaacttgatttcctgggccctgatggacactagcataactgtccaggcagcaggatgaagaaagtcatgaagagcacacttgcccgtcacacacggcttctgcttttacctcatggaccaaaacttagtcttgtggccacatctagctgcaagtgaagctggcaa

SEQ ID NO: 68189 - DNA, 424 bp, Homo sapiens
tcacctgtgaaatgaggacagtaaggacacaagtatcagcttcatggagttgttgtaaaaattaggaaaaataatgcatccaaatcacttggcatagtgcctggcacgtagttgtgttaactgttaattatagcacttgtccgtttttgctatttaagttttttttttctttctttcttcctgttagtcatttttagaataggaaaaattgccagataaactaactggttgaattcagcgtcaatcagatgtcaccctaataatggtcaaataagttagtagtaatctattatctctggtgtccaaaagttttcactggggtgtctgtggatgaaacacagagttggagttgagatttcttcacttccatccttccattccaatatcagatgtaattttttcttaatgtctgagaataatagta

SEQ ID NO: 68190 - DNA, 307 bp, Homo sapiens
attcccaaaaatagagtctggacctcttaccgctacaaattccaggttctcaggtacagcctgagagtatgcagatataatacaccacagatgattctctcccttttttttttttttttttgagacagaatctcattctgtcacccaggctggagtgcagtgggctgatctcggctcactactgctcccgcctcctggattcaagcaattctcctgcctcagcctcccgagtagctgggactacaggtgcacaccaccatgcccatccaatttttgtatttttagtatagttggggtttcaccatgt

SEQ ID NO: 68191 - DNA, 1321 bp, Homo sapiens
taaaaaagttatttcaatcaagtcttagttttattcctcactatataggaaaaaaatctttaatgcctcaaaagttccattcagcattacatttgcattactcttatttgcagcaaatatgagtaaaattataggtttttaaaggtctctaataacatccacttatattggttttgtagataatccataaattaccagaaataaattattccacatttattacacacccatgtaatagatgtcgtgccaggccctggaatatactaatggcatcacctcatgtggtaaaaagacacattccgccatcctggagtatacaaaggtagactagcatatagttcatgtgctcaaggagttcatttttattgacatgatacagatagaattgtagtttagggaatcaaaatctaataaaatgaggctaattccattttcccattaacactaataactagtgtgtaaatctgaatatgacacattctatatgaaagaagctctgtgtgcatctacactaaatactcgtgtgtgccaggtactgttttaaactacgtatatttttttaattctcataactgttctctgaggtatgtactaatactaaagcttattgttaaaggaaggcagaaaaattaagtaacttggcctaagtttgcataactgtgatctgggatcaatatttgaacccatacaggctgattgcagagcctgcactcttaatttgagtgtgatatttatgtgcagtacctggctataagtacccacaaaacgtttcaaattctttataaaatttgcttagttaaaaaagtaccaattgcataatatggttataagtctggtagaagttaggctttttacaagacatgctgcttactgcaccaaggaggcaagaaggctttttagagagcccagaatttcctttcctcaactcctgcttccaagacagtcattttgcatgataaccgtttccccaaaaaacacagacacaaaatttaaagaactggaacagaggaagcagagcttatcatagtatatatgtttagtaccctgtcacttaggtccacccctctttctttgtggattgtggacattttgtttaactgctaaatcatgagaatatatgactgctgagacttttccaaggattttttaaaaaacacattaggctttgtgcagaagtaaagaaaaagtgctgtgagaaccccaggtaggtaatttactttctattgtactcatagtttgtttgaaacctcttcacctctatcccttattgttttatactctgtaaatctgattttacctttaataaacttttctgaagtga

SEQ ID NO: 68192 - DNA, 1460 bp, Homo sapiens
taaaaaagttatttcaatcaagtcttagttttattcctcactatataggaaaaaaatctttaatgcctcaaaagttccattcagcattacatttgcattactcttatttgcagcaaatatgagtaaaattataggtttttaaaggtctctaataacatccacttatattggttttgtagataatccataaattaccagaaataaattattccacatttattacacacccatgtaatagatgtcgtgccaggccctggaatatactaatggcatcacctcatgtggtaaaaagacacattccgccatcctggagtatacaaaggtagactagcatatagttcatgtgctcaaggagttcatttttattgacatgatacagatagaattgtagtttagggaatcaaaatctaataaaatgaggctaattccattttcccattaacactaataactagtgtgtaaatctgaatatgacacattctatatgaaagaagctctgtgtgcatctacactaaatactcgtgtgtgccaggtactgttttaaactacgtatatttttttaattctcataactgttctctgaggtatgtactaatactaaagcttattgttaaaggaaggcagaaaaattaagtaacttggcctaagtttgcataactgtgatctgggatcaatatttgaacccatacaggctgattgcagagcctgcactcttaatttgagtgtgatatttatgtgcagtacctggctataagtacccacaaaacgtttcaaattctttataaaatttgcttagttaaaaaagtaccaattgcataatatggttataagtctggtagaagttaggctttttacaagacatgctgcttactgcaccaaggaggcaagaaggctttttagagagcccagaatttcctttcctcaactcctgcttccaagacagtcattttgcatgataaccgtttccccaaaaaacacagacacaaaatttaaagaactggaacagaggaagcagagcttatcatagtatatatgtttagtaccctgtcacttaggtccacccctctttctttgtggattgtggacattttgtttaactgctaaatcatgagaatatatgactgctgagacttttccaaggattttttaaaaaacacattaggctttgtgcagaagtaaagaaaaagtgctgtgagaaccccaggtaggtaatttactttctattgtactcatagtttgtttgaaacctcttcacctctatcccttattgttttatactctgtaaatctgattttacctttaataaacttttctgaagtgagtgagttttttttgtcttatttcccattagattctctaccttctttgttcactttacgtatgttattgccactcccttcaaaactggtggtttaattaaagtgacagcatcttctatatacccagtactgttgaggatt

SEQ ID NO: 68193 - DNA, 570 bp, Homo sapiens
gtcacggtgcttggtcgcgttattgggtccgggaattcagagaatctcgttgtccagggccagctgatacttcaccctcttatcccaacgccaacccttgatagatgcgaaccagtcgtatttcctttgtgggaaaggagtcgctttttaaagacgtgcactggccatctagggaggagcttttacttcaactcaaaataggactggagctgactggtgacctggcgctcgatggacggaaacgctgttcttgccgcttcggcagctcccatactggtgggagaggcaaacttgcagtctgctcatcttaagatggtgaatgttgagatagggttgctcccgaaaagccgagaagaggagccgtttgacccaacttgagggtgatccgatagacactctttagggcgtctgcagagtgggtgcgcgtggagacagtcaataagagaaaatcgtaaatacagatggtattctaaatctagcatgcatgtaaagttgtgtgacattttaaagattacattttacactttagtattgttttcatttttaatcacataaatgggggaacaccat

SEQ ID NO: 68194 - DNA, 478 bp, Homo sapiens
gtcacggtgcttggtcgcgttattgggtccgggaattcagagaatctcgttgtccagggccagctgatacttcaccctcttatcccaacgccaacccttgatagatgcgaaccagtcgtatttcctttgtgggaaaggagtcgctttttaaagacgtgcactggccatctagggaggagcttttacttcaactcaaaataggactggagctgactggtgacctggcgctcgatggacggaaacgctgttcttgccgcttcggcagctcccatactggtgggagaggcaaacttgcagtctgctcatcttaagatggtgaatgttgagatagggttgctcccgaaaagccgagaagaggagccgtttgacccaacttgagggtgatccgatagacactctttagggcgtctgcagagtgggtgcgcgtggagacagtcaataagagaaaatcgtaaatacagatggtattctaaatcta

SEQ ID NO: 68195 - DNA, 1253 bp, Homo sapiens
  misc_feature (564)..(564): n is a, c, g, or t
  misc_feature (1242)..(1242): n is a, c, g, or t
gggagagctggattagcaaaggccaaccaggagcccatcctcctgcagacccatctccaaataccatcccattgggggttaagttttcagtgtatgaattagggagacacagttcagtctactgcacccacctacctactttaggaagaaaacatggagttgtcaactttattcggtagtgtcacatttagacgtggcttctctgccctcctgggaacactctgctcctctggcaacatggtgtatggctcaatccaccttctcgccactgcatccctactgctcagtccctccttttcacgagtggttggctggacttctctttcatagacacattcgctactacaagtccagtcacaaggttaatgagctcagtttccatgctgataactcctccaacagcttgacctcagttccttgttctcttcactccatttacatttacttgctcttgaacatgacttcatccactgattctcatagtcaaacaccagatcaaaattcacctttgctgaaatgccatgctctggtcacacttacctgtccttccagctttgtgatgancacacagctattcatttttcccagaggtgccagtccattttccaccccatccctttcttttagtcccctttatctgagctcactttcccaatctaagcaggattatgtggcttttcaattaagacactcttgctaatattttaaattcccttggcctattgtcttttcagtgtatttgttggtcttttcaatgtatttattcagtggtctccagcttcagctctcttcactcctattcttatcggaggttctacttccctgaggaaaaagtcagtcattgtatggacagtctttgaccttctgtcctgccctctgtcagccagactttgtactcataatcattctagtctgttatcctgtttatcacagaaataattttaagacattgatattgggcccgttgcagtggctcatgcctgtaatcccagcactttgggagaccaaggtgagtgtattgcatgagtccaggagttcaggaccagcccaggcaacatggcaaaaccccatctctacaaaaaaatacaaaaaaaaaaaaaatagttggatgtggtgggtgtatctgtggtcccaactactcaggaggctgagtggaaggatcacctgaacccaagaggcagagtttgcagtgagctatgattgttccactgcactccagcctgggcaacagagtgagatccntctcaaaaaaa

SEQ ID NO: 68196 - DNA, 476 bp, Homo sapiens
  misc_feature (26)..(26): n is a, c, g, or t
  misc_feature (72)..(72): n is a, c, g, or t
atggctgaaactggcccgcaaggagnatgtcactgttaagatcaggaaaaaatgtaagagtttacggttctntcctgtcacgctccaagttggggtatatttagacattcatgagtagttgctggtgttcatttaattgtatatgtaaagtgtaattataatgtgcctggcctccttatattaattttcagtgacagaattgaaatattttaaactctcagtttagtactttcttaaatgattatgttgaattttttttggtttttaaaatttttaattttattattattattattttttgagacagagtctcaatttgttgcccaggctggagtataatggtgcaatcttggctcactgcagccttaacctttgggcgcagatgatcctccaacctcagcctcccaagtagctgggactataggcgtgtgccaccatgaccagctaatttttttttaatagagacagggttttgc

SEQ ID NO: 68197 - DNA, 233 bp, Homo sapiens
gttagtcatcttagttactgagttttctaaggccacctaaatttcatactcaaggcgagtgcttcctttgtcttcccctaatcccaggcctggaaaaagccatcatatcaatgttttaaagatcactttcttatagtgatgagtacgggttgctaaagactttggtggttaaaaaccgagaaattgagggaaattcagtatctatcataatagtttaggtggaaaaccacaga

SEQ ID NO: 68198 - DNA, 393 bp, Homo sapiens
ccattgtctttgtcgatctccggacttatttctccttgagccacggatacagcttttttctgactttgcacctctgtgcgatacatgtattgggttttcaaaatgaaatgtgagctgagctttcctatgttggcgcattctcgtttatgctaaagtgttactttttattggctccgatttgaaaattcaactacctgaacctcgtgggatcccttcgtctgtagggagcttgaagttgatctccccccatctgcattcatgcctggagaatattgattttagggcttattcctaaagtcatttcatgggacacaccctagatcaaaactttcttttttcacttgattattattaaacttgtcattatggacattttcaaacgtctccaaaggt

SEQ ID NO: 68199 - DNA, 185 bp, Homo sapiens
tacaatggagatcatatagctcacaaagcttaaaatatacattatctggccctctacagaaaagtttgctgactcatattgtaagccataaaactatgttctctgaccacacggaatatattcttagtaacagaaacatatctagaagtccccaaatacatggaaacaaaaaaccacacatctaa

SEQ ID NO: 68200 - DNA, 606 bp, Homo sapiens
tattaaaacagaaggggaaacaaaaggagactgagaggattgcttttgaagggtcatgttgcagcggcttctgctggatactaaaaagcaaattattatcgggggttgtttgtcattcacaggaggaattggattcctttatgtttataaagtcaccttggtatctggaaggagagcagaaactaacagagcctactttacttaaggcccctggcgctggttctctctggaggttgagtttccgtggggagagaagagtgcccagcgtgaccaccgttggctgacttcccatgccttattccttgtttcccccgctggggcccagcccaccagccccgcagtgcatgaagccacttatcaccacggttcccagagaggacgggctggcccaagtctgcattgtcacctgctctggggaaaacaaagccctctcccccgccctccccgcagcatgctgggcacagggccagcccgttctatgttttcagtaaattttcaaacatgctggttttggtggcagcttttgcagtgattatctcattaggggcttggccctgaaacaccttatttattgtggattgaaaaaagttcaccttttcaagcaaa

SEQ ID NO: 68201 - DNA, 350 bp, Homo sapiens
ctttttttctaaacaaggtcacattcacagtttcacattcacaggttccgggagatgcctttcaaaccacttcagccattcaacctgccacaataaccctatttgattgtttatctgatttttccctacaatggttgatgccccaaattatagctccaacacatttgatctgaatatttagtactcttgaaatatatttttaaatttctctcaaaaggataatcattttgtgccttctgatatacaaggtgtgagtgttgtcaacagttttccatgattcactccattctgggacttgcaatagcaagcaactgagaacttctaaaactacttaatttttatttcttctg

SEQ ID NO: 68202 - DNA, 275 bp, Homo sapiens
catatgaggtaattctgattgtttatatatacacatctttgtttatatgagtaaatatgtatggatgtataacgcataaaaacaaagttattggaaatgtatgatactttatagttgaattatataaacaaatatttgttttgtgtaaaacaaactaaatagttaaaattatttgactcctattttaggaggtaaatgtagtaaatgttttgaacagaaaatatatgacaaagtgctatggtaccacaagcttaatgcaattctcaaattgcttt

SEQ ID NO: 68203 - DNA, 117 bp, Homo sapiens
taagcaccaaattttgttgttttttttttctcccctccccacagatcccatctcaaatcattctgttaaccaccattccaacaggtcgaggagagcttaaacaccttcttcctctgc

SEQ ID NO: 68204 - DNA, 2330 bp, Homo sapiens
cgccctgccagccggcagcaaagggccctgggcaaactccaggaggcggaggaggctagtggcagtacctgggcaccctgaccctccccacaggccagagcccaccctcctgctcatgagggcagacaggcctttccagggacacagtccctcttctccccaggaccccagggccaactccccctgccggccctctgccatcaaattggcagtggctccaggggagtcccctggggatgggggaccactgttggggacccctctgcgtgcacccctgtagttggggaagcaggacaggggcctggggagacggaagggcgccaggggttgagagaggatggtggacgttgttggacttgaaagggaaacaggccctcggggaagcccctggccaggcctgcctctcccctccctggtgggcccagcgcccctgctcacttgtctctgcccacagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacactcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 68205 - DNA, 2180 bp, Homo sapiens
ggctgtaccggccggagattttgggatcaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcaccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacactcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 68206 - DNA, 960 bp, Homo sapiens
cgggcgggacttactcaaggctcctcccaggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtcctaggcccgtgcctgatccaggatccaagctcccggaagctggcactgggcccgccctgggtaggcagcagtgagcaaggcgggcggacagcgctgggctcgcggggtcctgcgtcctccgcgggagtgttggcggcgggggtcgctctgcgcggggacactgggcagagggggcgtgcggcctctctaggaagctttctcggagccccagacactggcgaggcgccgcgccccctcttctggattccggcgcgccccctgaacccgggagctacgagcggagtcgcttctccctgcagccgtcctgggtctggcgcggacgcaccccccggccgaccccgagccgctgcagccggcgcccctgcggcttccaacccgcgctgctccgcccgcagcggaggccccgcacttcgcgcgataggggttt

SEQ ID NO: 68207 - DNA, 492 bp, Homo sapiens
cacgcctttttcttgggcgtaacgatactttcttgttttatttctcatgattccgtttctaggtcctaggcccgtgcctgatccaggatccaagctcccggaagctggcactgggcccgccctgggtaggcagcagtgagcaaggcgggcggacagcgctgggctcgcggggtcctgcgtcctccgcgggagtgttggcggcgggggtcgctctgcgcggggacactgggcagagggggcgtgcggcctctctaggaagctttctcggagccccagacactggcgaggcgccgcgccccctcttctggattccggcgcgccccctgaacccgggagctacgagcggagtcgcttctccctgcagccgtcctgggtctggcgcggacgcaccccccggccgaccccgagccgctgcagccggcgcccctgcggcttccaacccgcgctgctccgcccgcagcggaggccccgcacttcgcgcgataggggttt

SEQ ID NO: 68208 - DNA, 1860 bp, Homo sapiens
cgccctgccagccggcagcaaagggccctgggcaaactccaggaggcggaggaggctagtggcagtacctgggcaccctgaccctccccacaggccagagcccaccctcctgctcatgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccggtgaggcctgggctgggctgtggaggggggcacccccgattccccagcctccacgtccctggggggcagggccggaacccacacagactcgcggtgccaactcttctccctgccagagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtgagctgcgccctggggtaagatggggcctcaccggggtctgcttgggcccctgagcctgtcctgccaccccccaggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 68209 - DNA, 668 bp, Homo sapiens
cacagaggaggtggccagcacagcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 68210 - DNA, 2273 bp, Homo sapiens
ggctgtaccggccggagattttgggatcaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcaccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacactcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttggaaaaaactcacccctcttaccatcaataaaatacataaaaactatatcatctatacctaatctcacaacatcaacacaaccaaacacaaaatcc

SEQ ID NO: 68211 - DNA, 2272 bp, Homo sapiens
ggctgtaccggccggagattttgggatcaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcaccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacactcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatggtcaggatggcgaggggaggggctgctctgggccgggagctgagcagaggagctgagcaggggcgctgacccggtgcccacttgctcctcagctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 68212 - DNA, 2114 bp, Homo sapiens
ggctgtaccggccggagattttgggatcaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcaccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacactcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 68213 - DNA, 2461 bp, Homo sapiens
ggctgtaccggccggagattttgggatcaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcaccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacactcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtcctaggcccgtgcctgatccaggatccaagctcccggaagctggcactgggcccgccctgggtaggcagcagtgagcaaggcgggcggacagcgctgggctcgcggggtcctgcgtcctccgcgggagtgttggcggcgggggtcgctctgcgcggggacactgggcagagggggcgtgcggcctctctaggaagctttctcggagccccagacactggcgaggcgccgcgccccctcttctggattccggcgcgccccctgaacccgggagctacgagcggagtcgcttctccctgcagccgtcctgggtctggcgcggacgcaccccccggccgaccccgagccgctgcagccggcgcccctgcggcttccaacccgcgctgctccgcccgcagcggaggccccgcacttcgcgcgataggggttt

SEQ ID NO: 68214 - DNA, 343 bp, Homo sapiens
ccaagcgtccgcccacgcgtccgaggacgggtggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 68215 - DNA, 2434 bp, Homo sapiens
tgttattactatttttgagacagagtctagctctgtcgcctaggctagaagcaaaactccaactcgaaaaaaaaaagaccaccgaggctgcctgtccaggggaaggggcccagccctcgacccccacaggcagtggctccaggctgttggggaggatctgccactggaatggttaacccaggcatctccagcagccaatcacagagctttgcaggaatacctgggagaggtcctcatgcagcccgggcgggtcctagcccagccccagtctggccctggacaaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcaccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacactcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 68216 - DNA, 679 bp, Homo sapiens
cgggcgggacttactcaaggctcctcccaggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 68217 - DNA, 802 bp, Homo sapiens
cgggcgggacttactcaaggctcctcccaggtggcggaggagagcccggagctgctgaaccctgagcccaggagactgagcccaggtgagcccagggggcgaccccggaagggctgggggatctggggtttgtgtggagcgcgggtggggcccaaggcttggcggtaggcgacaggccacgcgaacccacgggcctctgcgcccgcagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 68218 - DNA, 2196 bp, Homo sapiens
ggctgtaccggccggagattttgggatcaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcaccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacactcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtgagctgcgccctggggtaagatggggcctcaccggggtctgcttgggcccctgagcctgtcctgccaccccccaggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccaggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatggtcaggatggcgaggggaggggctgctctgggccgggagctgagcagaggagctgagcaggggcgctgacccggtgcccacttgctcctcagctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccctagtcccccacctttgacttaagatcccacacctcacaaacctacagcccagaaaccagaagcccctatagaggccccagtcccaactccagtaaagacactcttgtccttgga

SEQ ID NO: 68219 - DNA, 2110 bp, Homo sapiens
ggctgtaccggccggagattttgggatcaccccagcaaagccgccctcagccagcccagaagcactgggccttggccacagcaacacccactgagcacgctgggagctgagtatggcgtccctggtctcgctggagctggggctgcttctggctgtgctggtggtgacggcgacggcgtccccgcctgctggtctgctgagcctgctcacctctggccagggcgctctggatcaagaggctctgggcggcctgttaaatacgctggcggaccgtgtgcactgcaccaacgggccgtgtggaaagtgcctgtctgtggaggacgccctgggcctgggcgagcctgaggggtcagggctgcccccgggcccggtcctggaggccaggtacgtcgcccgcctcagtgccgccgccgtcctgtacctcagcaaccccgagggcacctgtgaggacactcgggctggcctctgggcctctcatgcagaccacctcctggccctgctcgagagccccaaggccctgaccccgggcctgagctggctgctgcagaggatgcaggcccgggctgccggccagacccccaagacggcctgcgtagatatccctcagctgctggaggaggcggtgggggcgggggctccgggcagtgctggcggcgtcctggctgccctgctggaccatgtcaggagcgggtcttgcttccacgccttgccgagccctcagtacttcgtggactttgtgttccagcagcacagcagcgaggtccctatgacgctggccgagctgtcagccttgatgcagcgcctgggggtgggcagggaggcccacagtgaccacagtcatcggcacaggggagccagcagccgggaccctgtgcccctcatcagctccagcaacagctccagtgtgtgggacacggtatgcctgagtgccagggacgtgatggctgcatatggactgtcggaacaggctggggtgaccccggaggcctgggcccaactgagccctgccctgctccaacagcagctgagtggagcctgcacctcccagtccaggccccccgtccaggaccagctcagccagtcagagaggtatctgtacggctccctggccacgctgctcatctgcctctgcgcggtctttggcctcctgctgctgacctgcactggctgcaggggggtcgcccactacatcctgcagaccttcctgagcctggcagtgggtgcactcactggggacgctgtcctgcatctgacgcccaaggtgctggggctgcatacacacagcgaagagggcctcagcccacagcccacctggcgcctcctggctatgctggccgggctctacgccttcttcctgtttgagaacctcttcaatctcctgctgcccagggacccggaggacctggaggacgggccctgcggccacagcagccatagccacgggggccacagccacggtgtgtccctgcagctggcacccagcgagctccggcagcccaagcccccccacgagggctcccgcgcagacctggtggcggaggagagcccggagctgctgaaccctgagcccaggagactgagcccagagttgaggctactgccctatatgatcactctgggcgacgccgtgcacaacttcgccgacgggctggccgtgggcgccgccttcgcgtcctcctggaagaccgggctggccacctcgctggccgtgttctgccacgagttgccacacgagctgggggacttcgccgccttgctgcacgcggggctgtccgtgcgccaagcactgctgctgaacctggcctccgcgctcacggccttcgctggtctctacgtggcactcgcggttggagtcagcgaggagagcgaggcctggatcctggcagtggccaccggcctgttcctctacgtagcactctgcgacatgctcccggcgatgttgaaagtacgggacccgcggccctggctcctcttcctgctgcacaacgtgggcctgctgggcggctggaccgtcctgctgctgctgtccctgtacgaggatgacatcaccttctgataccctgccccagcccgcccccgcccagccgtccgcaaagatctctaagtacct

SEQ ID NO: 68220 - DNA, 245 bp, Homo sapiens
taattacaaataagcttgagcccctttttgtgtttattggctatttcacttttgataataggtgatattagggaataatttaagtggaatgttattttagaaatccatactgaaatacttaaggatgtaatactaatttactgtaaaatatttcagcataaaaaaagtgcagacatagataacatttcactgacatcagaaaatattacctgggaatacatcaaaaagtattcaagaactctgtc

SEQ ID NO: 68221 - DNA, 2013 bp, Homo sapiens
  misc_feature (67)..(69): n is a, c, g, or t
  misc_feature (554)..(554): n is a, c, g, or t
  misc_feature (558)..(558): n is a, c, g, or t
  misc_feature (566)..(566): n is a, c, g, or t
  misc_feature (569)..(569): n is a, c, g, or t
  misc_feature (573)..(573): n is a, c, g, or t
  misc_feature (581)..(581): n is a, c, g, or t
  misc_feature (1150)..(1150): n is a, c, g, or t
  misc_feature (1443)..(1443): n is a, c, g, or t
  misc_feature (1772)..(1772): n is a, c, g, or t
  misc_feature (1883)..(1883): n is a, c, g, or t
  misc_feature (1886)..(1886): n is a, c, g, or t
  misc_feature (1888)..(1888): n is a, c, g, or t
  misc_feature (1893)..(1893): n is a, c, g, or t
  misc_feature (1896)..(1896): n is a, c, g, or t
  misc_feature (1908)..(1908): n is a, c, g, or t
  misc_feature (1929)..(1930): n is a, c, g, or t
  misc_feature (1932)..(1933): n is a, c, g, or t
  misc_feature (1947)..(1948): n is a, c, g, or t
  misc_feature (1950)..(1950): n is a, c, g, or t
  misc_feature (1952)..(1952): n is a, c, g, or t
  misc_feature (1965)..(1965): n is a, c, g, or t
  misc_feature (1970)..(1970): n is a, c, g, or t
  misc_feature (1979)..(1979): n is a, c, g, or t
  misc_feature (1982)..(1982): n is a, c, g, or t
  misc_feature (1986)..(1986): n is a, c, g, or t
  misc_feature (1994)..(1994): n is a, c, g, or t
  misc_feature (2000)..(2000): n is a, c, g, or t
  misc_feature (2008)..(2008): n is a, c, g, or t
  misc_feature (2010)..(2013): n is a, c, g, or t
attccgggctatacgtgaatttaaagattttttggttgacaattttttggctgagtttgtctaaagnnntgggattacaggtgtgagccactgcctggcctgaaatgggttttgactgcttctaagaccctgctcagtcccagttcctctgagttgctcagtgatatcttcaataaaagctgggactggccatattgaattttacctgggccctgctcacaggtgcaccccttgttgatctatggggccctgccccagacccccaaattcccattcttggtctggcaagtgatttgctgaactgtttgtccccactgatcaatgggggaaaaatgcctgttcatgagactttggttctttcctaacttcccccccactccttaccttcctgcaggcccctgaactttagccccacctcagtggagccggcacagggccccatcagagctcccaacaggaatagggtcacctcgggctctatctctccatacccaccttccacccacttctctggttctcttttggttttgttgtgttgttttttttttttttgngacngagtctcnctntgtngcccaggntggagtgcagtggggcaaaagccacagacactcaaggccagccagtgcaagcagccggcagccgggaggggggctgaaccccaaaaagccacagggatggagctgcccaaggccatgggagcccacctcttgcatcagtgtgacctggatgtgagacatggagtcaaaggggatcatttggaactttaaggtttaatgactgccctattagattttggacttgcatggggcctgtagcccctttgttttacccaatttcttccgtgtagagtgggtatatttacccaatgcctgaacccccattgtatgtaggaagtaattaagttgctttcaattttacaggctcataggaggaagggacttgccttgtctcagatgagactttggacttggacttttgggttaatgctggaataagctaagactttgggagacagttagaaaggcatgattgtgttttgaaatgtgaggacatgagatttgggaggggccaggggcagaatgatacagtttgtccgtgtcccccacccaaatctcatcttgaattatagtttccataattcccaagngtcctgggaggaacccggtgggaggtaactgaatcatgggagcagttactgccaggctgttctcgtgttagtgagtgagttctcaggagatctgatggttttataagggccctttccccgctttgctcagcacttctccttcctactgccctgtgaagaaagtgcctttcttcccctttgccttccaccatgattgtaagtttcctgagactttcctagccatgcaggactgtgagtccattaaacctctttacttataaattagccagtctcgggtctctcttcatagcagngtgagaacagactaatgcaggggggctattatgttgccaatcacaggtatataataaaaagttaagaattataatttctaagtggtaggatttcccttaatccttttctcttatctatattttcagaagttttcccaggaatacacatactgcttttgaaatgagaagaatgaaatctcatttatagtctatattgacgtctttgcaatgttcattaatccacctctcaggacagccctgagaagtgcatactgttcctgaacagttaacagttacaaagatgaattgaaaagtatttaggcggccaggcgtggtggctcacacctgtnatcccagcactttgggaggccgaggtgggtggatcacgaggtcaggagatcgagaccatcctggctaacacggtgaaaccccatctctactaaaaatacaaaaaaatatgntgngnacctntantcccagctactngggaggctgaggcaggagaanngnntgaacctgggaggnngngnttgcagtgagccnagatngcgccactncantccngcctgggngacagngagactcnannnn

SEQ ID NO: 68222 - DNA, 347 bp, Homo sapiens
ctgtgctatcaagcacataagccgaagcacaagaatagtttgaggggcaggtggagtttcatttaacaaaaacattggtccactattattaagacacaatttgaagtcagacttttctttccgtggtaagtccgaggtaatcaaaatcattctcttcaatgtcattgtgggattctcagacattcagatggtgaaaacaaagaaataatttcatttattccattatatttagagtttagaagtagcaagaaacactatatcagtttgtccccctaaggaaaggcatggacaccttgtttcttcttgcaaatgatttaagcaactaagatttcagaaccaattttcag

SEQ ID NO: 68223 - DNA, 1919 bp, Homo sapiens
gtccatttgcggtggtaatcgcaggcacatgctgggagccaggctttaagacatctgccttagccccagcagtgtcaccaaaccctggcctaagctgcccacgcagatctgagagaagcagaatactctcagtccccgccctcatagagctagccctaactttcatttatatcactccatctcatgccaggaaggatttaaggtgacaaaaattacttatcctatagggaagcaggccaagcccaggttctgaggaacggcagtcaggatgcaggaatgagcccagctcagtttagctttgtgtatttgaagcacagagagtcactgagccagagccagattcagatgccagaagcctctatcctttgtatccatcccactccgagaatggcagtgaagagaaagggtctcacagagacctggctggccgagagatgagccaaggtcctttgtggccgtgtcctgcagcagtcggacctgcttgactagactggactctgtgtgaattctttcccccaaccccagacttctcaaagtgctcccacgctaaagctttctgcatctggccctccctgctcctggcaacccctctaacctcctaaatcccagggaagagggagagcaagctggcagaacacccagatgtcctgggtgggagtgcttacatcactgtgtctaagtcatggggaaacaggccaaatgctatagtgggtgagcacctcttgggcaggtccccccaagcccagcagcacatgtgttcaacatgcaaaagcagactcacaccccaccctctgaggcttagtgtgactcccaggattcctagcagagcctggtctggccctctttagagacaagatcaacaccatttattaagaacccaccaagagaacccacaaccctgcccttgaggaggtttcagtgtgctggcaaaaccaagacaagccacacacaagaccatttataggactctttgaaacacttataaagcaaagataaacatattaagatagattaacaccatgcaaactgaatgcgcatagactgacgatatgcagtaatggagagtttagagatgggtggagttaattagggaaggcttttggaagatgcaaattttaggcagaatttacaagtaggtaattggcagagagcaggaagtacatcccagaatttcctgttaaaagcatgggttttgctgtaagacaaagccccacattgtcatttattaactttgcagtcctggaaagtcatttgacctctctaggcttaaggtccttcacctataaaacagaggtaataggccgggcgtgagccactgcacccggactgtgctttctttttcaatcgaggttagagttggccatgagggaacttatataagatttggaaggcagaagcaaaagagcagccattactctcagaaggtcactgtggttggatatggtgttggccaataggtcaaacctccatgtccatctgctctttcttatgtcttgccctgatatccaatagcagccacagctgatcaaaagatgcttggctacggatccacagagaggtggttatgcagaggtaatagcttcccatgcatagccttccacacgagctcctgttcttgatcccgctttgctagttgaacatgcctgctgctcaaatttccgtgcgagcctagggtttggcttgcctacaccactgctcctaggcactctggctagggactttgctatctgactcctcttccagacttttgcttctccagtactgcccacatttttgtaagatctaattcctactaaaaaaaaattcctctttccataattcttatcatgattctgcttctttcactgaatcctggatgatacagataagtatcaatcagtcaacagtagttacctctgaaaacggaaataaaagtgatt

SEQ ID NO: 68224 - DNA, 202 bp, Homo sapiens
aaaggcaagctcgccactgctgcatggaaggctgatgccccagcttgcccatgtagcagaaagctctgggtctcgatatctgctcggcttcttaacagctatgtggctttgtacaagtaactctgtctctctgggcctcaatttcctcatctgtgaaataggataataaatgtacagaccacataggtttcctgtgaggact

SEQ ID NO: 68225 - DNA, 730 bp, Homo sapiens
gcagtcccgcttcctatctcatcctcattacctatgggataaagcccaagcagggtgccatgtatgaccatgcactgcatagcccacaaaatcatacacagcaggcctgagtcccatctccttcattcagcaagtattcaatctccagacattctcagctggcacccaagggtcctgagggtcctgttgctgtctttttcttctgctttctctctcacctactcccttaggtaccatgtacttgagccacaccaaacttggtacatcttttcatacctgtgtgcttcacacacgaatgtctccatctgctttctgtgaatgctggggcaataggatgggcatggacttgaaatcctgtttctctgccatttacagttaggtgaatgtgggcaagttaaccctctgagccccagttttctaatctgtaaaatgggattaggcttatataatgtgcctcagattgtatgtagcacatgagagcccctccccactcctaaaagttggtttctaactctctttgcatgccgaactcctattcatccttgaagacccaactcaaatgttaccttcttggtaacattgccctccttcccttcaagtgggtaaagtttatctttctcagtttctactctttccaccagccctgcatagcacttataaacctctgttggaaacactgtcatatttttctgttttcctggttcacatgaataaagcacacagccagaaa

SEQ ID NO: 68226 - DNA, 576 bp, Homo sapiens
acctcagctttgcatttttaatacaatttcagtctattctatcaacccaaatacataatattttccaaataagaaaaatctaaaatatgtttttaaactcaacttgaaatcagagaatttaaagttttgaataaaattgacaaatatttattggtaatctttaacttatacatttggctacatatattaaaaatttgtattttatttaaatattctcatttttccactttcacatttcaagcaatttattcaaattcttcacataggttaaagacctcagtctattgcaagggcattctctgagctacttaatacctcttcccagcactcatcatttccatttccatttaagttacctgagaagcagaactttctgaatgtaagcatgatggtttacttatctgaacataacttctgggagtctatttggagttattccttcactctctgaagagttaaaaattaggactattctggccgggcgcggtggctcatgcctgtaatcccagcactttgggaggccgaggagggtggatcatgaagtcaggagattgagaccatcctggctaaaacggt

SEQ ID NO: 68227 - DNA, 362 bp, Homo sapiens
attttaatgaaataggatagagcagaaaatagattttattgcagataataagggtaaagtgctgttttgaggaacttgagtttcagatatacacacacatatgtgcaaatgagtacatgtgcatgtcctgagttgtgatataaaaggcatttctttctgtggactatggtttaagaagcttgaaaatcagtgatccagatagatctttggttccttctgaccctctgaacttctaacttattatgactattatctggcactttgctgaagtcttcttttccacttcaagtcctcctaccagactgtgtggcaactaagtccacatggctgacagggtgaacacccaagcccccagttccttg

SEQ ID NO: 68228 - DNA, 417 bp, Homo sapiens
gctaaaaattcaagatacaaaaaggtatctccctctcacctgttcccacagccaccttcccaggggtgcctatattttcagatgttttaggcctgtaagcatatacttacatgcataaaagtaggtaagtgcatatccttccacacatgtaagtatatacatacatatatatacatacacagtcatgcaccacctaaagacagagatacattctgacaaatgcatcactacatgtttctgtcactctgttaacatcttagagtgcacttacacacacctagatggtacagcctgttagacacctaggctgtacggtagagtctattgctccaaggctacaaacctgtacagcatgttatacactgaatactgtaggcaactgcaacacaatggtaagtatttgtgtatctaaacaac

SEQ ID NO: 68229 - DNA, 339 bp, Homo sapiens
atcactttgtcaaactctagattacataggatactcttatcacctatctagtattaaagactcttcctggaaataagaggaaatcattcaaagaagggttagttcttcctctgtcctgaagtaattcagtttttattgatggttgaggataagataatctttaaaaaagtttcatccacttctgggcgtgtcatgacaaatgggcttatctgaagcattggtttgacttttttgtttgtttgtttgtttgagatggagtcttggtctgttgctcaggctggagtgcagtggcgcaatctcggctcactgcaaccggatccgagagctcccaacgcgttg

SEQ ID NO: 68230 - DNA, 457 bp, Homo sapiens
gagcaagaccctgtctcaaaaaagcaaaaaagcaaaaaaaaaaaaaaaaaaaaaaaggaagtctttcttcagatacttacgtgaaaaaaacctgcaatatcttttaagtgaaaaaaacagtgccaagcagcacacatagtataagccccaaccaacctttttttttttttttttttgagacagagtctggctgtgccctgccactttctaagctttgcgaagagtgagttgactgagcagccaggtagatgtgggttcagatctctgcttctgtcctgctgtgccaagtgctggggcagacacaggcagagagtggacagcggcatggtgcctgctgctagccatttctatgcaaaaccagatgtctggtcccatcctggaggccaattctaggtatgtgggtgggcctgggaacctgtgaaacaagtaaactgacttagacaccccccaccccgcc

SEQ ID NO: 68231 - DNA, 1522 bp, Homo sapiens
gaattcctcgagcactgttggcctactgtaaagttattggaaattgtgatgccaaggatttccccatcaaatataaagagaggcatcctctggagtacctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcaggagcttttactcaagtgtttacctttggtccgaccttccgagctgaaaattctcagagccggaggcacctggcagagttttatatgatagaagcagagatttcttttgttgacagccttcaagatcttatgcaggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagtcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttt

SEQ ID NO: 68232 - DNA, 1332 bp, Homo sapiens
actccagaatggtatcttgtttttttaattttatacttctttgattaataatcagaatttattttatatgtcctaataacaatactacaaattaaactcttcattgccacattataagaaaaaacagacaaaaatatacacaccttaaatgttcaactaaaaaggaaagcagttaaataattataattctaatcaataaactattaaacattaaagctattaaaacataatgtgaagtatttttactaatataggaaaaatattagtttgtaatattaggtaagacaagtggtaagtttttatctgtaattatactttataaatgtataagggaaaaaatttgaaaggaaatccacaaaaatgtaattttccggtgctgataggtgatttttaatgtttcataatttttaacactatccacatttttataattaacatttctatcacatttatgaagaaaatacatttgtgttcagtatactacacaaatggtgcaagagagaggaaattgtccacttataatttgtatgtagtcagtaagattctggtaggtagttaattagccattgccaaaatgttaaaggtttacttgcttcagaaactgactgttggaatcacctgaaaatataatgctaataattttttttttttccttaggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttt

SEQ ID NO: 68233 - DNA, 825 bp, Homo sapiens
actccagaatggtatcttgtttttttaattttatacttctttgattaataatcagaatttattttatatgtcctaataacaatactacaaattaaactcttcattgccacattataagaaaaaacagacaaaaatatacacaccttaaatgttcaactaaaaaggaaagcagttaaataattataattctaatcaataaactattaaacattaaagctattaaaacataatgtgaagtatttttactaatataggaaaaatattagtttgtaatattaggtaagacaagtggtaagtttttatctgtaattatactttataaatgtataagggaaaaaatttgaaaggaaatccacaaaaatgtaattttccggtgctgataggtgatttttaatgtttcataatttttaacactatccacatttttataattaacatttctatcacatttatgaagaaaatacatttgtgttcagtatactacacaaatggtgcaagagagaggaaattgtccacttataatttgtatgtagtcagtaagattctggtaggtagttaattagccattgccaaaatgttaaaggtttacttgcttcagaaactgactgttggaatcacctgaaaatataatgctaataattttttttttttccttaggttgctgctgttgatcttctggttcctggagttggggaactctttggaggaggcctcagagaagaacgataccatttcttagaggagcgcttagccagatacaatacctgaaatataaaataaataattatacatcactctagcatatagttatgaatatattataac

SEQ ID NO: 68234 - DNA, 2550 bp, Homo sapiens
ccttcttccccgtagcgtgatgacgtaagcggcgttggcgtggtgaggtaggagtggttgcgcgtgttgcggcccgggttctgttcgtaggtttacaattgtcgcgggtagtggggcgccccagctgccaactgcacgtggtttctttctggcgtttgcctagtgtcctgtccattccgccccgttgggaagtgggaagcggagaggttctgtggggacagagctgggagtcctgaaggagaaagcgcgcagccgaggggctctggagtgccttagagcagagctgcggccgcggaaggggagcagctgagaaaggagggccgctgcaggcggggttcgaaccgtggggtctgggctgctcccgcggagggcctgggcggacgcgggatgctgggggtccgctgcctgctgcggtccgtgcgcttctgttcctccgcccccttccccaagcacaaaccttcagccaaactgagcgtgcgggacgctctcggggctcagaacgcgagtggggagcgcattaagatccagggatggattcgttctgtccgatcccagaaggaagtcttgttcctgcatgtaaatgatgggtcatctttggaaagccttcaggttgttgcagattcaggccttgacagtagagaattaacttttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtacctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcaggagcttttactcaagtgtttacctttggtccgaccttccgagctgaaaattctcagagccggaggcacctggcagagttttatatgatagaagcagagatttcttttgttgacagccttcaagatcttatgcaggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagtcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68235 - DNA, 2119 bp, Homo sapiens
ccttcttccccgtagcgtgatgacgtaagcggcgttggcgtggtgaggtaggagtggttgcgcgtgttgcggcccgggttctgttcgtaggtttacaattgtcgcgggtagtggggcgccccagctgccaactgcacgtggtttctttctggcgtttgcctagtgtcctgtccattccgccccgttgggaagtgggaagcggagaggttctgtggggacagagctgggagtcctgaaggagaaagcgcgcagccgaggggctctggagtgccttagagcagagctgcggccgcggaaggggagcagctgagaaaggagggccgctgcaggcggggttcgaaccgtggggtctgggctgctcccgcggagggcctgggcggacgcgggatgctgggggtccgctgcctgctgcggtccgtgcgcttctgttcctccgcccccttccccaagcacaaaccttcagccaaactgagcgtgcgggacgctctcggggctcagaacgcgagtggggagcgcattaagatccagggatggattcgttctgtccgatcccagaaggaagtcttgttcctgcatgtaaatgatgggtcatctttggaaagccttcaggttgttgcagattcaggccttgacagtagagaattaacttttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtacctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaatggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68236 - DNA, 2226 bp, Homo sapiens
ccttcttccccgtagcgtgatgacgtaagcggcgttggcgtggtgaggtaggagtggttgcgcgtgttgcggcccgggttctgttcgtaggtttacaattgtcgcgggtagtggggcgccccagctgccaactgcacgtggtttctttctggcgtttgcctagtgtcctgtccattccgccccgttgggaagtgggaagcggagaggttctgtggggacagagctgggagtcctgaaggagaaagcgcgcagccgaggggctctggagtgccttagagcagagctgcggccgcggaaggggagcagctgagaaaggagggccgctgcaggcggggttcgaaccgtggggtctgggctgctcccgcggagggcctgggcggacgcgggatgctgggggtccgctgcctgctgcggtccgtgcgcttctgttcctccgcccccttccccaagcacaaaccttcagccaaactgagcgtgcgggacgctctcggggctcagaacgcgagtggggagcgcattaagatccagggatggattcgttctgtccgatcccagaaggaagtcttgttcctgcatgtaaatgatgggtcatctttggaaagccttcaggttgttgcagattcaggccttgacagtagagaattaacttttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtacctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcaggagcttttactcaagtgtttacctttggtccgaccttccgagctgaaaattctcagagccggaggcacctggcagagttttatatgatagaagcagagatttcttttgttgacagccttcaagatcttatgcaggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttt

SEQ ID NO: 68237 - DNA, 2364 bp, Homo sapiens
ccttcttccccgtagcgtgatgacgtaagcggcgttggcgtggtgaggtaggagtggttgcgcgtgttgcggcccgggttctgttcgtaggtttacaattgtcgcgggtagtggggcgccccagctgccaactgcacgtggtttctttctggcgtttgcctagtgtcctgtccattccgccccgttgggaagtgggaagcggagaggttctgtggggacagagctgggagtcctgaaggagaaagcgcgcagccgaggggctctggagtgccttagagcagagctgcggccgcggaaggggagcagctgagaaaggagggccgctgcaggcggggttcgaaccgtggggtctgggctgctcccgcggagggcctgggcggacgcgggatgctgggggtccgctgcctgctgcggtccgtgcgcttctgttcctccgcccccttccccaagcacaaaccttcagccaaactgagcgtgcgggacgctctcggggctcagaacgcgagtggggagcgcattaagatccagggatggattcgttctgtccgatcccagaaggaagtcttgttcctgcatgtaaatgatgggtcatctttggaaagccttcaggttgttgcagattcaggccttgacagtagagaattaacttttgggagttctgtggaagtacaagggcagctgataaaaagtccatccaaaaggcaaaatgtggaactgaaggcagaaaagaggcatcctctggagtacctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcagggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68238 - DNA, 1187 bp, Homo sapiens
ttcatccctccccttcccattccgttccatatatataactggttcttcgtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68239 - DNA, 1657 bp, Homo sapiens
actccagaatggtatcttgtttttttaattttatacttctttgattaataatcagaatttattttatatgtcctaataacaatactacaaattaaactcttcattgccacattataagaaaaaacagacaaaaatatacacaccttaaatgttcaactaaaaaggaaagcagttaaataattataattctaatcaataaactattaaacattaaagctattaaaacataatgtgaagtatttttactaatataggaaaaatattagtttgtaatattaggtaagacaagtggtaagtttttatctgtaattatactttataaatgtataagggaaaaaatttgaaaggaaatccacaaaaatgtaattttccggtgctgataggtgatttttaatgtttcataatttttaacactatccacatttttataattaacatttctatcacatttatgaagaaaatacatttgtgttcagtatactacacaaatggtgcaagagagaggaaattgtccacttataatttgtatgtagtcagtaagattctggtaggtagttaattagccattgccaaaatgttaaaggtttacttgcttcagaaactgactgttggaatcacctgaaaatataatgctaataattttttttttttccttaggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68240 - DNA, 1630 bp, Homo sapiens
actccagaatggtatcttgtttttttaattttatacttctttgattaataatcagaatttattttatatgtcctaataacaatactacaaattaaactcttcattgccacattataagaaaaaacagacaaaaatatacacaccttaaatgttcaactaaaaaggaaagcagttaaataattataattctaatcaataaactattaaacattaaagctattaaaacataatgtgaagtatttttactaatataggaaaaatattagtttgtaatattaggtaagacaagtggtaagtttttatctgtaattatactttataaatgtataagggaaaaaatttgaaaggaaatccacaaaaatgtaattttccggtgctgataggtgatttttaatgtttcataatttttaacactatccacatttttataattaacatttctatcacatttatgaagaaaatacatttgtgttcagtatactacacaaatggtgcaagagagaggaaattgtccacttataatttgtatgtagtcagtaagattctggtaggtagttaattagccattgccaaaatgttaaaggtttacttgcttcagaaactgactgttggaatcacctgaaaatataatgctaataattttttttttttccttaggttgctgctgttgatcttctggttcctggagttggggaactctttggaggaggcctcagagaagaacgataccatttcttagaggagcgcttagccaggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68241 - DNA, 1656 bp, Homo sapiens
actccagaatggtatcttgtttttttaattttatacttctttgattaataatcagaatttattttatatgtcctaataacaatactacaaattaaactcttcattgccacattataagaaaaaacagacaaaaatatacacaccttaaatgttcaactaaaaaggaaagcagttaaataattataattctaatcaataaactattaaacattaaagctattaaaacataatgtgaagtatttttactaatataggaaaaatattagtttgtaatattaggtaagacaagtggtaagtttttatctgtaattatactttataaatgtataagggaaaaaatttgaaaggaaatccacaaaaatgtaattttccggtgctgataggtgatttttaatgtttcataatttttaacactatccacatttttataattaacatttctatcacatttatgaagaaaatacatttgtgttcagtatactacacaaatggtgcaagagagaggaaattgtccacttataatttgtatgtagtcagtaagattctggtaggtagttaattagccattgccaaaatgttaaaggtttacttgcttcagaaactgactgttggaatcacctgaaaatataatgctaataattttttttttttccttaggttgctgctgttgatcttctggttcctggagttggggaactctttggaggaggcctcagagaagaacgataccatttcttagaggagcgcttagccagtcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68242 - DNA, 1185 bp, Homo sapiens
gttgaagctgtcgcgaccacagttcctacgaaatagtaaaagcacttctggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagtcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68243 - DNA, 925 bp, Homo sapiens
atgattgactggagtgacaaaactaaagagacaggaaagaaaggttcagtgtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68244 - DNA, 676 bp, Homo sapiens
accccctctgccttcttattccactttatttttcttcatagcacgaatagctacttgtttatttatctgtctactctctcctcacctgcatctctcgctctctctctctctgacacacacatgcgcgcacgcacattgtctccatgaaggctgagctttatttttatctccagtgcctagaattgtgtgtagtgcctagtaggtgccaagtatatgtctgttggataaataaatgaattaatggtgaattttaggaaaaagtattttgctgttgtagtcttttaatagggcattggcatatcatggattcagagaataatctttacttgcttaagtgactagcttcactgtgtatattgcaagtagatgaggagttgaggttattgaatggttacttgtcttcaggcagatcattctttcataggattagatcagccttaattcctgattattcatgacctcacagtgtgatataggagtacgctttttctggttttaaaatgaactagttagcagctccattgtattgacttttctctgcttgtatcctgttttcctccagcatttcttatactgaagcagtggagatcttaaagcaagcatcccagaacttcacctttaccccagaggtagtattttgtgtgtatgtatatatgtgtgtgtgaaaatgcttcct

SEQ ID NO: 68245 - DNA, 185 bp, Homo sapiens
ttgctgctgttgatcttctggttcctggagttggggaactctttggaggaggcctcagagaagaacgataccatttcttagaggagcgcttagccagtcgggacttacagaagtctaccaatgagaaattgagcataaggcgctcaaaggtggtcattgcatagtaacagagtgaagaccctggg

SEQ ID NO: 68246 - DNA, 2551 bp, Homo sapiens
ccttcttccccgtagcgtgatgacgtaagcggcgttggcgtggtgaggtaggagtggttgcgcgtgttgcggcccgggttctgttcgtaggtttacaattgtcgcgggtagtggggcgccccagctgccaactgcacgtggtttctttctggcgtttgcctagtgtcctgtccattccgccccgttgggaagtgggaagcggagaggttctgtggggacagagctgggagtcctgaaggagaaagcgcgcagccgaggggctctggagtgccttagagcagagctgcggccgcggaaggggagcagctgagaaaggagggccgctgcaggcggggttcgaaccgtggggtctgggctgctcccgcggagggcctgggcggacgcgggatgctgggggtccgctgcctgctgcggtccgtgcgcttctgttcctccgcccccttccccaagcacaaaccttcagccaaactgagcgtgcgggacgctctcggggctcagaacgcgagtggggagcgcattaagatccagggatggattcgttctgtccgatcccagaaggaagtcttgttcctgcatgtaaatgatgggtcatctttggaaagccttcaggttgttgcagattcaggccttgacagtagagaattaacttttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtacctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcaggagcttttactcaagtgtttacctttggtccgaccttccgagctgaaaattctcagagccggaggcacctggcagagttttatatgatagaagcagagatttcttttgttgacagccttcaagatcttatgcaggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68247 - DNA, 2070 bp, Homo sapiens
ccttcttccccgtagcgtgatgacgtaagcggcgttggcgtggtgagggatggattcgttctgtccgatcccagaaggaagtcttgttcctgcatgtaaatgatgggtcatctttggaaagccttcaggttgttgcagattcaggccttgacagtagagaattaacttttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtacctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcaggagcttttactcaagtgtttacctttggtccgaccttccgagctgaaaattctcagagccggaggcacctggcagagttttatatgatagaagcagagatttcttttgttgacagccttcaagatcttatgcaggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagatcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68248 - DNA, 2496 bp, Homo sapiens
ccttcttccccgtagcgtgatgacgtaagcggcgttggcgtggtgaggtaggagtggttgcgcgtgttgcggcccgggttctgttcgtaggtttacaattgtcgcgggtagtggggcgccccagctgccaactgcacgtggtttctttctggcgtttgcctagtgtcctgtccattccgccccgttgggaagtgggaagcggagaggttctgtggggacagagctgggagtcctgaaggagaaagcgcgcagccgaggggctctggagtgccttagagcagagctgcggccgcggaaggggagcagctgagaaaggagggccgctgcaggcggggttcgaaccgtggggtctgggctgctcccgcggagggcctgggcggacgcgggatgctgggggtccgctgcctgctgcggtccgtgcgcttctgttcctccgcccccttccccaagcacaaaccttcagccaaactgagcgtgcgggacgctctcggggctcagaacgcgagtggggagcgcattaagatccagggatggattcgttctgtccgatcccagaaggaagtcttgttcctgcatgtaaatgatgggtcatctttggaaagccttcaggttgttgcagattcaggccttgacagtagagaattaacttttgggagttctgtggaagtacaagggcagctgataaaaagtccatccaaaaggcaaaatgtggaactgaaggcagaaaaaattaaagttattggaaattgtgatgccaaggatttccccatcaaatataaagagaggcatcctctggagtacctgcgacaatatcctcactttaggtgtaggactaacgttctgggttctatattgaggattcgcagtgaagcgacagctgctattcattctttctttaaggacagtggctttgtacatattcatactccaataatcacatccaatgactctgagggagctggagaactttttcaacttgaaccttcaggcaaacttaaggtacctgaggagaatttcttcaatgttcctgctttcttaactgtctcaggacaacttcatctagaagtgatgtcaggagcttttactcaagtgtttacctttggtccgaccttccgagctgaaaattctcagagccggaggcacctggcagagttttatatgatagaagcagagatttcttttgttgacagccttcaagatcttatgcaggttatagaggaactgttcaaggctacaacaatgatggttctctcaaaatgtcctgaagatgttgaactctgtcacaaattcatagcacctggccaaaaggacagattagaacatatgctaaaaaacaactttttaatcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagtcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatgaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68249 - DNA, 1558 bp, Homo sapiens
gatgtggagggagcttgtacatcggaggtctggaccaataaggtccggagcaactccgtacttaggttgctgttaatcgggtgcacctgtcgtagagggatgttgttagatagcttagacttgctgggtggtgagctagtccgattccaagatcattagtgctaggttagtagaggcactgtctatcgtgggtctatcaaatatatgatgtgtgcgtactcaattagtgtccatgcaatagtgatgtaagtctagtgtcaatgttccagtagccactctgcgccatatagtgatcagggattaatgtgacgatattgctaggagaatacgagacttattctgaatgcattctcttagtactgaagcagtggagtagtcttatagcgcaagcatcccggatcttcacggtttaccccagagatggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagtcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68250 - DNA, 1279 bp, Homo sapiens
gtccttgtacttgctgttccttttgcctggaatactcctcccaagatacttctatggttcatttccttactcggtcatttcttatactgaagcagtggagatcttaaagcaagcatcccagaacttcacctttaccccagagtggggtgctgacctacggactgaacatgaaaagtacctggtgaagcactgtggcaacatacctgtcttcgttattaattatccattaacactcaagcctttctacatgagggataatgaagatggccctcagcacacggttgctgctgttgatcttctggttcctggagttggggaactctttggaggaggcctcagagaagaacgataccatttcttagaggagcgcttagccagtcgggacttacagaagtctaccaatggtatctggaccttcgtcgatttggatctgtgccacatggaggttttgggatgggatttgaacgctacctgcagtgcatcttgggtgttgacaatatcaaagatgttatccctttcccaaggtttcctcattcatgccttttatagctggaagattggttaaggaaaagcaccccccatggcagagacactgcacatgattgtgcatacagcagaatgcatgtttggattttagaaatgcagatttcaatatgtaattgttgtgccataagatatcatagaaaaaatataagtggttgtgattttcttagaaagttgagggtatttcacgtaaggatgagctcccgcaagaagaggtacttatagcaaggggactctcaaatccattacctcaattaagaaatgaagaaattgaattagtctcaaagtttcttttaaactctaaaacagaatgagataatgtattttacgttgtctataatcattaaatcactccctgtgtaatttgtgagaaccatctagtagctcgaaataaaataatgttgcatcttttctcccttgccatatactttgtgataaatccttatctcattttcagtacttcattaaacattgcagaaaaaaatattccttaaggtcttaattgatttaaagaagtagctattctgaattgaaatctcctttcattgaactggatgaaaaaatcatgtttaataactgttgcttttcaattttcaaagctgttgagatattacattaagtatttcaactctttaatcactgttgttataatttgtttatatttgatgtttataatttgtctaataaaatagatttttttaatagaaaaaaaaaaaaaaacaactcgcgactagat

SEQ ID NO: 68251 - DNA, 371 bp, Homo sapiens
ggcagaggttgcggtgagccgagattgcgccattgcactccagcctgggaaacaagaacgaaactccgtctcaaaaaaaaaaaaaaatctggaggcaaattaacattatttctcaaataagtacagcaggccagtgtgttcatgtacatgaccccaatttgcacatacgctaagtgagggacaaacttgatcatgggcctgaaggatccggttgcagtgagccgagatcgccccactgtactccagcatgggcgacagagtgagattccgtctcaaaaaaagaaaagaaaagaaaagaaaacagcactcactgatggcttctatctaccataaacaattttctttttctttttaatttttttgagacgcag

SEQ ID NO: 68252 - DNA, 634 bp, Homo sapiens
catctgtttacttttaagaattgaaattttcttccagaatctccgaacaagaccctaagctatgacatccagttcaatgactattcgtctcccaaatatacgtacgcttttaataaatatgtaaatctttggaccaccttccaagtatggtgtgttcaacagatagtagtatgttactaccgtctgtaactaaaattttcaggggcttaacacaagagtaatttctttctggctcatataacactttaataatgcaggtgtcataatgtcagtggacccagtctccttccataccttagaacaggggtcaagaaacattttctgtaaagggccacatagtgttttaggctttgtgagccataaggtctgtctcaactatttaactctgcctctgcagctgttgctccacagacaatacttgaaaataaatgggcatggttatgttctagtgaaattttatttacaaatccaggcagcctgcttggacaaaaaaaaaaaaaaaaaaaaaaaagtcacacctacttttaaccacatgagcccagaaatgacacacagcattttctctaccatatcattactaagaatgaggcctcatcaagataaaagggggtatttcagtaaggccagatttaca

SEQ ID NO: 68253 - DNA, 809 bp, Homo sapiens
atttgccatgggacaccggaaggattgtgtacgtgcagccgcccccaagaaacacaaggacatgacttagcttctgtgcccacccccatggccattggtcttacatataccatacctggatatcattcattctcctcaaaagaaggagaatccactcaaaatgaacatcaggatgtgagctcccatcatggagatgcccaggcagaaaccagaagacgatgcagtcaggcatgggggcggggttggaggaggagctctgggacctcctctgcactgagattctgtgattctgcttttgttctgtgttccccgttctgcgattctgcttttggatctcacattgtttcttcctgtaaagcccttggcaaaaagtgctatccgactgtatgttgtcataccaagactttcatcacacagtgttttgccaacatcagactgtgcggataaagggttctttgagaaaatctatttcacgagtcttgggtcctctgccttcagaattcagcacccacctccctccacccccaccttcagtcacagacgaatgaatagtcgcagaagtgctcacatcctcccgcttctagttctttctgcctagcccctacacagtctccaaggccagcagtttcctgggtttctccactcagggagacatctattgcgcaccttctgttggcagcactgattgctgagccctggactccagcacagacgtgaaaaccctgttccaactggatccaacccctgactagctttgagactttggacaagttacttactctatctagtattcaccttcctctttcaaa

SEQ ID NO: 68254 - DNA, 286 bp, Homo sapiens
ttttaaaaaaacctgaaaagccaaaataacttgttgggaagtttcaatgtttacttcacctaaactaaggatgcctttggagaagaagtgctcagagccagactagactttgaattcatttactgagcctgttacataccagacactgggcataccccctttttttttttttcggtttgctttattgtgccttgcagatttttttttttttttttttcacaaaataaaggttgtgtccaaccccgtgttgagtgagtctattggcatcattttgccaacagcaaaa

SEQ ID NO: 68255 - DNA, 2714 bp, Homo sapiens
  misc_feature (1327)..(1327): n is a, c, g, or t
  misc_feature (2099)..(2099): n is a, c, g, or t
  misc_feature (2257)..(2257): n is a, c, g, or t
  misc_feature (2654)..(2654): n is a, c, g, or t
  misc_feature (2714)..(2714): n is a, c, g, or t
actctgtgatgttcacacaacaactaaataatttgatgtatccctgcgattaagcaacacatgattagtatgaagaatggtttgatagttgaaggaaattaactcaaaactcatttgcttccagggctagtaatatgttctacatcatgtatcaccccacgcctcaaactctagccctgtacactaacttatcacaaaccttggatttttttgcacaattatcaaaatgacatatcaaaccaaccgtacatcttgacataaaaacagtatgagacaaaatgaaattctcttgggatattgaaaaaattttttttgcctgtgaatttagtaattttacttattaagaattttcaaatgatttcagttcttaaactgaaaaataaaattcaaaaattaattgcattttttccagtgtttcttctatgtctttatattggtagaactgtccaactatatggtaaggatgtgaaatgttaaatttacttgaactagagttacaatgaacattagaattaataatcagacttcttttttttttctttttttgagaagggagtttcgctcttgttgcccaggctggagtgcagtggcacggtcttggctcaccgccacctccaccttccagattcaagcaattctcctgccccagcctcccgggtagctgggattacaggcatgcgccaccacacccagctaatttttgtattattagagatggggtttctctgtgttggtcaggctggtcctcaaactcccgatctcaggtgatctgcctgccttggcctcccaaagtgctgggattacaggcgtgagccacttcgcccggccaataatcagacttttagtagtaaaattactttcaaaaatggagattcctttgtcaaatagtactattattagtactaagattgtaaagaggttatttgtgtctgattttgagtttgatgctacagagaagacaggttaggcctgcattgacgtttttcatcaagggcagaattgatgatacagaaacttgatttctgtctaggcatggtggctcatacctacaatcctggtgctttgggaggcggaggctggaagctcactcgagactaggagtttgagaccagcttgggcaatgtagtgagaccaccgtttctacaaaacaaaaaacaggtttctttagttaagtataaatcattgatctgtgattaatccaaacactttttcctcagtatagaccttggggttcttcggtgtttgactaccttcttttgaaggaaaccaccttttttttttttttttttttttttgaggcagtctcactctgttgcccaggctggantgcagtggcacaatctcagcccactgcaacctccgcctcatgggttcaagtgattctccagcttcagcctcctgagtagctggcattacaggcatgcaccaccatgcccagctaatttttgtatttttagtaggggagggggtgtttcgccatgttgcccaggctgttctcaaactcctgacctcaagcgatccacccaccctggcctcccgaagtgctgggattacaggcatgatccaccgtgcccacccgaaaccacttgtaatatacctttaggagaatgcttttagttacatcatgatccctttcatgtagctaacaacaaaaatgaatattaaccccaaatattggaactcgtattttgaagcaagttatttcttggtatactttagtgccagaattggtactgttatgtgattaactgtttttgagactaagaaaatattttgctggacatctgatgaaattatcttaaaaacagtgcttgggtgttttccctggagtgtagtggcaagagtactctgttgtccatcagagccacttgctgctctcagctggccttgctgttgaatggcataatctgatttcgttggagtacccaagtcctaagatttgaagaataagggttattatctcagtctcatcttttctctgagatagcatttgttcaggaaatgttatctgttttcaatggtgaagggagtgagagtctgcttaggagttactgtatacattaaacattggtgaccggcctttaaagaattagaggctnggcctggtgacttacacctataatcccagcagattgggaggccagggcaggaggatatcttgagcccgggagttcaagaccagcctaggcagcatagtgagaccctgtctctacaacaaaatttttacttttttatttttatttttattttttgaganggagttttgctctgtcacccaggctggagtgcagtggcatgatcttggctcactgcaacctccacctcctgggttcaagcgattctcctgcctcagcctcctgagtagctgggaccacaggcgagggctaccatgcccagaatatttttgtattttttttttggtagagatggggtttcaccactttggccaggctggtcttgaactcctgacctcaagtgatccacctgcctcggcctcccgaagtgctgggattacaggcgtgagccactgcacccagccctacgaataatttttaaaaataaattagttgggtgtggtggcacacctgtggttctagctactctgtgaggctgaggcaagaggattgcttgggtccaggagatctagactgcantgagctgtgatcatgctacagcactcgaagcctggggaacagagcaagaacttgtctcan

SEQ ID NO: 68256 - DNA, 473 bp, Homo sapiens
tggccactgaaaagcaagttttatgagtgcataattttaaaagttcagagatcactccagtggaccgcaagggggagggattcattctatactttgagatcatttattaggaaaaataaaacatactaaagaaaggaaaagaaaatatagcatatatgttacattttaaaaattaaatttttaggccaggcatggtggctcatgtttgtaatcctagcactttgggaggctgaggtgggaggatcacttgagcccaggagttcaagaccagcatgggcaacatggtgagactctgtctccacaaaaaataaaaaactagcctgacatggtggcgcgtgcctgtggtcccagataccccagaggctgacgtgggaggatcacttgagcctgggagtttgtggctgcagtgaaccatgattgtaccagtgcactctagcctggccaacagagtgagaccatgtctcttaaaaaaa

SEQ ID NO: 68257 - DNA, 1024 bp, Homo sapiens
  misc_feature (37)..(37): n is a, c, g, or t
gaattccacaaggaaatcatctcaggaggaagggctnatacttggatccagaaaatatcaacatagccaaagaaaaacaatcaagacatacctccaggagctgtgtaacagcaaccggaaagagaaacaatggtgtgttcctatgtgggatataaagagccggggctcagggggctccacacctgcacctccttctcacctgctcctctacctgctccaccctcaatccaccagaaccatgggctgctgtggctgctccggaggctgtggctccagctgtggaggctgtgactccagctgtgggagctgtggctctggctgcaggggctgtggccccagctgctgtgcacccgtctactgctgcaagcccgtgtgctgctgtgttccagcctgttcctgctctagctgtggcaagcggggctgtggctcctgtgggggctccaagggaggctgtggttcttgtggctgctcccagtgcagttgctgcaagccctgctgttgctcttcaggctgtgggtcatcctgctgccagtgcagctgctgcaagccctactgctcccagtgcagctgctgtaagccctgttgctcctcctcgggtcgtgggtcatcctgctgccaatccagctgctgcaagccctgctgctcatcctcaggctgtgggtcatcctgctgccagtccagctgctgcaagccctgctgctcccagtccagatgctgtgtccctgtgtgctaccagtgcaagatctgaggctctagtgggaaacctcaggtagctcctgaagatctgtgctttccaacaagtgactacccttgaagcacatccccttctggatctgaaaagagcccttggctcagggcgtctttttccagcccctgaggaaatggaatgaaccactccctgcccattccctataagaatatcccaagacccaggcaattttgcccctctttcccacatgcccccatatgtctgagccaaactgcactgggggctgccctcatgccaagcaagagcctggaattc

SEQ ID NO: 68258 - DNA, 324 bp, Homo sapiens
taggaaacaacaagaaagtattagtacctactgtgtctcaagaactgtgctggaattaacccttaaaaatagcttgtgaaaaaggtgctgtttttcccattccacagaaaaggaaactgaaccctagaaaagatgttgactacccctagatctctctcactgagaagtggtgaaaaataaatccagaagccaggttttcccaagtccatattttttcattaggcttgtatcctcaaagataaaactcaactgagtgaactgagaaatttcaatttaagccaagttcattttccagagggtttagacatgataaaggtgacacag

SEQ ID NO: 68259 - DNA, 1765 bp, Homo sapiens
gtatcaacgcagagtggccattacggccgggcatcatttgtctgtgctattctgtttttctccaaacactataaacttgaagcaattgccctgactcgatttcagagaaggggatgtgttggaaagagcaagaataagaaagtgaccagattctgctgcagtctggtaaccccacgagtgtcagggactacttgcatgtttacttctatccttcatttgttttgattcaagcctttatgtgctgtggactcacctccctaagtaaccaggttcctcctctcgctgcaaccttgtttgcatccttcccaagaagaggctttgggaaatttttctgtaattacacttaccaaagagccatggaaccattaggatctccactgtgatgagagttaagccatagtgccatttcacacgtatacatttatgatgggatgggaacccgatacaatctctgtaggctgaatccctagttttatttccagtgagctgcttctgtgactgaagcacctctgtgggcttttgggaaccatggatgcacagatgagagagcacaggctcagagagtaagatggatttctagtgctagccaggtgaatgacacacagtgtatttcaagtttgaaaagcaaaaccatggtatctgacagtgctgattgtaatcacctcccaccactgtgcattttaaacatgagaacaaaaaacttttccaaaatttaaacttttcctaaatctttgtggtcattgctagttgttgacatcagatcctttggttttattctataacttgggctaaacgttaatatcccactaggtggaacatgtctcttccggagttgtgacaaccgaggctcagagctgtgatttttagaaaacaagatgactattaaatcctttggcctggtattcttgaatgtttttctcccagtgcttcccttgcctgtatggagcatctgcaaagtctgagcaggttttgaagtccaagagcatcccagctataaggctcttgcactgtgacagagctgcccacctccagtacaccctcagtgacctcgagtagatgcgtagggcagtcaaacccggcaacttatgccacaaccctaattccaggaagtcgtctgctaatggctaacccactgccatggtggcactggttttgcctgaggtcattgctagggcaggaatgaacagcaaccagcacagagcattgctaaattaattacagtaatctaattaattagtagctaggcttcttctgataggaaagtttcaaccagaaaccactagatgttctattatcatagcttttgtagattggatggaagaataagtaggaagaaagagtattaatgtagctagtagggaccagtgttgctgcttgtggctgaggcagtaatgctaaggctttagctcttcaaaagcagaatgaaaaggcacaaaaagcacttcaagcttgtttctgtacccagttgtccctgtattgtctacataaaatcctgtttcctgctatctgtctgtgattcctgtttattacaaattcagtgtgtctgactgatattaaacactgatattaaaatttcaaacttcacttatctgtgctgttgtgaacaggcagctgatctggcagccctcgaatgggaaacaagtgcttctgttgagctgtagcatatataatataaatgtgcctatgtgtattaaaatgtcttctgtaaacaatgaaaaaaaaaaacaaaacaccaaacaacaaactaacacaacaaaacagaggg

SEQ ID NO: 68260 - DNA, 1483 bp, Homo sapiens
  misc_feature (39)..(39): n is a, c, g, or t
  misc_feature (97)..(97): n is a, c, g, or t
  misc_feature (113)..(113): n is a, c, g, or t
  misc_feature (142)..(142): n is a, c, g, or t
  misc_feature (148)..(148): n is a, c, g, or t
  misc_feature (151)..(152): n is a, c, g, or t
  misc_feature (220)..(220): n is a, c, g, or t
  misc_feature (359)..(359): n is a, c, g, or t
  misc_feature (967)..(967): n is a, c, g, or t
tgagatggagtctctgttgtccaggctggagtgcagagntgcaatcttggctcactgcaacctctacttcctggattctgcctaagcctcccgagtngctgggattacaggcncgtaccaccacgcctggctaatttttgtnttttcngtnnagacggggattccccatgttggccaggctgatctcaaactcctgacctaaagtgatccacctgcctcngcctcccaaagtgctgagattacgggcatgagccactgcgcctggctacctcctgtgcatattaaagccacgttccacagcggagatccaggcaaaggatgtgctttgtagaccacatgatggagatttggggtgtttngttctcagttcataggaaaggccggaaaccagttcacttcgtcatttcagcgatcgctgtcctaggtttcaggcacttcaatgtaacgttgacatgagcccttccttttctttctttttcttttttaataaacagccagttttactgaaaaactggctgttgttacttcctgattctatggaactctaagtcaaaatcataaaagatagcatctaagcatatttcatactaacatccggaaatactcacacctaaattttgagaaacaaaatgtcccccagctttttgctgatacttccaccaatgtcacaggattatttgttttagattttttttctttccaagcaggcctggaggtaaatgagctgcttggaaaagattgttctcagagtctcaacaggtcaggtacaaatgcaaaaaatctacaaaatactaaggattggggctgggagttggaagttctcataactgcatagtccagaggatatagtagggattagcatgatcccactagctacctagaaggtagaaaggggagacacaaaatttccaaataagcacatcctcaaacatgcatggaaaaattatggtcaactgagagaccaggntggaaaggagaggaatttgtgggaagatggagggtgtgctatatggatgtgaagttcttctgaatgtttttgaattcaattttcctccatccaaatgaaagctgactttataaaatagcacttttgggaggaaggtagaaggaggaatcatgcttaaaaaaattagcacattctaagtgatcagatgtgatctttaatattgaaagccctcaaatttagtcattggaaagagtcaagcccggttccagggctagcatctaattagtttacaacttcctgaatcaataccaaacaaatgatgaaataaagtagataaactagctttctatagcatttacctttattttctgtgtgctacataaggtaccagaggaaagagcctttgcaaaaaataaaaacaaaaatgaataagcccagaacaacttggggatactatcttcgtcttggactggtttatactggaactcctgggaggtgtctgtgctgtctctcacagacaaatacaaaaaaaaaaaa

SEQ ID NO: 68261 - DNA, 178 bp, Homo sapiens
ttcagcaattttaaaggtgacttccaataaaatatgtatgtagatttacttcggggctggtagcctgggctgtaaatttataccaagtcaaccatggaaagcccttcaattaaaaaagaagaaagaaaatacaaaaaaataaagtttccatcagcatttatctttggattttaaaaag

SEQ ID NO: 68262 - DNA, 4092 bp, Homo sapiens
  misc_feature (16)..(16): n is a, c, g, or t
  misc_feature (144)..(144): n is a, c, g, or t
  misc_feature (900)..(900): n is a, c, g, or t
  misc_feature (1422)..(1422): n is a, c, g, or t
  misc_feature (1438)..(1439): n is a, c, g, or t
  misc_feature (1671)..(1672): n is a, c, g, or t
  misc_feature (1823)..(1823): n is a, c, g, or t
  misc_feature (1851)..(1852): n is a, c, g, or t
  misc_feature (2334)..(2334): n is a, c, g, or t
  misc_feature (2582)..(2582): n is a, c, g, or t
  misc_feature (2812)..(2812): n is a, c, g, or t
  misc_feature (2827)..(2827): n is a, c, g, or t
  misc_feature (3051)..(3051): n is a, c, g, or t
  misc_feature (3171)..(3171): n is a, c, g, or t
  misc_feature (3279)..(3279): n is a, c, g, or t
  misc_feature (3344)..(3344): n is a, c, g, or t
  misc_feature (3629)..(3629): n is a, c, g, or t
  misc_feature (3809)..(3809): n is a, c, g, or t
ccagagcctcaggatnagcccgaagggggtctgtggggacagcagacacgaaaggacctggcccttcaaggctggaagccagtgtcctactgggagctcagtctgtagtgccagggacccctctgcatagagtgagactccccncacacacatgaggctggattagacaagatccttcagctcctcatagggttggactcatctcagcagaatatggcctctggaagaaggggtcccctaagaatttggggctttcctgggctcttgcaagataagtcttggcccagtctgcccacaatcctggccctgagcctcagcctctgccatgggacaccacctctcaggcagggcatggttggtgtgttctgcagggacctgcctgtgcctcctgctggaaggagctgagtttttctgtgggagccagaaccttgggccagggaagccaggcagtgtcaggcagcaggatccctggcctgggatctccctctgcatccttgtcccatcagtcaagcactgtgagcagtgctttaaggtagaaatctgggtgcagtgtcttcttgtcctcatggaaggagcagaggtgttcagagccccctgggctctcctgaaaaactccctatttcaggcctcactgcagacccttcccaaagttagaactccaggaaatgtcctgggctgtcactctcttctttaagacccctacctttgccctgatgtctccccattgcccctcagatgcctccatccttctagattccccacttcctctaggaccctctgttccccaaaggccttacttgatgctgtagcactcccagaatatgaaatggcttctcaaaatgtggttcatgtccaggtcagtctagttcattttccccgaggacatctttctctgcaagnttttctttttcattttctgaagggcaggaccaagagaaggaaccagctttggaacagacacaagactcactgccacaaagagcaatgtgtaacagtcggtgctggtggaaagaaaagaggctttttctctgcagaaatttttttttcttttgcttgtatctgaaaccagggaaggtcaccagagttcagttcacctgtggtgaccatgttactctctgtgcccaggatgtgctactggccccctaaccctcagcctccaggtggtgtccttgtggtcagtgggcagtgacccctgagccactatcatgaatcttggtggtggctttggtaaaacgactgcaggacagggtttggggccattcagcaggaattgtggccgcttccattgagggcatgtcgccccactcaccaccattaatgcccacaggccacacacactgcatcactgaccacccatcaggtcacccatggatggaccagccttccatgcagcagggacaggctcttacctttgcctctagngcactgagaggcgcanntctgtctcactggaaggcagtgaggagagctgaggacctgcaccaggctgggggccgtcctccttcccaagcaggccccaggggaggaccagctccacctccagccaccccaggtctcagcctccctgttggctgatacacagaaaaggctgggaaacgggagcagaggaagcacagagctgggcatatgctgcttgagattcatgggacttccggctacacagtggagctnnccctcctgggctggaggcagcatcctctttgggaactgagaaactccaatcttgagatgggccagtgctggccaggggtgtgtgcctggacagaagtgatgacattgccaggctgtggtgcaaggatcttggcctgaaaactgctccgtgnactgaggatgcatctggagcctgtcctnnctgatggccccacagccattgcagggtctgaccatatagcatccacctgcctctcactgaacacgagccactgactcttcctgcttcctcactttcccagcctgtctaacccaaagaccaggactgtcttttcagccactctggctcttcttttatccttacgctgtcaaaacctctaagcaagaacacccagatccacatacctgccttgtccactctttaactgggctgctcagcactgcttggggcaccaggggccatgagggtgactgaggtttcacaggcacctgggatggtcctgtacccagtccccagcctcaggtggtgcttggggctttcagtcagcagcctcctccctttcactgcagcagccctggcacagggcacctggctgtcctcccatttttctctgactcagcctcgcccatctgtcctctgatcatggtgttgaccaagtcagcagggagctgagtctccagagngtgctttggggactgaccgaagcctctctgctgaggggtccaggtgagtcgctgccccgaccccaccccatttactgtcgtccccagatccatccactccaccccaggctggctccatccagatgcatcccaaagtcatcagttcctttgggtcacccccaccccaactttcccaatgacctctgcaggcacagactccatactgggtttttcccaccagatttcagatcccctctcagcatgagacncttggtcaggttaccttagcagcaagctctgctgcctctttgctttctctctgagatgcccatgccagggccctgaccatcttctcctcccagggccacagcttttcctgcccctgtacccttgtacccttccctgtggggtggcagaactggtctcctttagccctcagagacctgctggacaactgcccacaggccatgccaagcatccccccaccctgtggccacancctgcaaatttccanggctggctccaaggaacagggctggaccctcaggctggccccctcctcctttgttgacttagagactgcactgctgagaacccagggggttggtccagccatatctctattcccaccgtttctctgggttcccacaatgggccactcaacactggcctaacactgacaccatgggctggacctgcagggcatctaggggaggagtgctgatactgggaaagggntgggtcatagccatggagacatgggcttcctcagagagacccttctaataacaaaacctatccccgagttgagattgctgggttgggggcgtgggaggcagaagacactgaagaatttgnagctgatgactttccagatcaaaaatcttcctgccccatgtccactggcatcccggcctggccaacctccgcctcctgggttcaagtgattctcctgcctcagcctcntgagtagctgagattacaggcgcccgccaccatgcccagctaatttttgtatttttagtagagangaggtttcaacatgttggccaggctggtcttgaactcctgacctcaggtgatccaccctccttggcctcccaaatctagtaaatgtcacataatttataaggcaatataagagaatatttcttatattaactgactgtcaaaagcaactgtgtaatactgtttgtatcttcatggctatcagatatataaatttaatgtatttgccaataacagcacagaggtgagtgcaggaaaagtacctcagcactcacactgccacactgctcacactgtccacaggaccntctgctttagcccagagggagggtcaaaccaagccaggcctggtgggctggacggggcaccacgagtcctcttggaaactgaacccacccctgacacaactcagattaaagacaggagtgtggtgagctcttccctgcctgggcctccccgatccgtggcctcctgtgcagaactggacnccaggggtgtccagaaaggacccagcactgcccagtgcaaggtgcccaggacagaaacagacccctccaaggagacccctcctggcctgatgcccagccccaaacctagaccctctcctgaagggagacatgagaaacatatttatcagaaactggaataaaaacatacactaaaagcccaggaagcttttgtgaattcctagcatctctacaccacactgattagtgacagtttattcctgcagtacacctgtctataacagtgaataaagtgcttgggttt

SEQ ID NO: 68263 - DNA, 3359 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttg

SEQ ID NO: 68264 - DNA, 976 bp, Homo sapiens
tgtttgcctgaactgtttgtacctctgggccatattgcagaaccctgcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttgactgcaccttttaattttaatgataatgatttgctgccacctacgggctaatgtggaaagagcagaacatgtcattaccaactttcttagatgctgaatataaaatctcaaggtcatcctggcagacttgaagccaactggacaacccgtcatcctcttttctgagagatttattttccttgatagcctagccgcatacttgaatagaaccagaatccccttggattctttttggaattgggcagtatacataaagcattgtgttagcagtcagatactgtatttctccccttgtttgagtagatttgcaaaacagtgtgtatcaaaaaagcatgaaagagtctttgctatttaagtaatggtttggtacctgagttttgcttgttttgttttggagatctgttgtagttggagaacctgggagttctgtacaaaacattaaaaataaaataacgtttaacaggtagct

SEQ ID NO: 68265 - DNA, 604 bp, Homo sapiens
ttttaccacgtttcccttgcccagacactggtgcctgcagaagctggttgtggtccatctggtccagctgcagccttgcacagagccggtgcctgtagctgctcaccctgctgcagcagctggtgtgcctggctgggcgcagtggctggaacctgcactcacttgctcacgcacccctcaccagcccatgcctggctcacccttggcaggtgtgggatctgggccagcagcacaagatgagcacagcctactgggcagagtgggcagaatgagcccagcaggcatgagcaaaactccagcagaggcgctgcaggccatggaagtttccagctggtgaagcgacatcctaagaactttgtgacactatcctttcttcttggtttgcacacatggttgaggcatgaatttctagtaaactcatggtcacctccacctagccgtcaatagctactattcattaagtgcccaggcatcttacactcatcacctttaactctttactcaggcatgtggcagtgtcaccattttatagataagaccaaagccagtagctgtaaagtattaggcttgaacttagcagtagaatgaaactattttctgttca

SEQ ID NO: 68266 - DNA, 4002 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaacta

SEQ ID NO: 68267 - DNA, 4288 bp, Homo sapiens
tgtttgcctgaactgtttgtacctctgggccatattgcagaaccctgcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaacta

SEQ ID NO: 68268 - DNA, 3886 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaacta

SEQ ID NO: 68269 - DNA, 3845 bp, Homo sapiens
ggagcttaaatagggattttacttagattttgcactttaaaaaatggtttaaatccccaaccaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaacta

SEQ ID NO: 68270 - DNA, 4141 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcgaggagcaagcttctagcagcagaaaccgaactgctctgtcttctgtattgagagccatctgcagagctgttacaagaagacatctgaaaccttatcccaggctggacagaaggcctcagctgctttttcgtctgttggctcagtcatcaccaaaaagctggaagatgtaaaattgcaagccttttcacattcctttagtatacgttccattcagcattcaattagcatgcctgctatgagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaacta

SEQ ID NO: 68271 - DNA, 3555 bp, Homo sapiens
aaccagtacctggaaggctcatctaaggtcttctaggcctagcattctaacatcaaatgatcatctgatgatcatttaaggttgttgaaaaattctggttgtgaacttctttgtctttttagttcttcatgatcatgcaggaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaacta

SEQ ID NO: 68272 - DNA, 3212 bp, Homo sapiens
aagcagtcgtatcaacgcagagtgtccattacggccgggattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaacta

SEQ ID NO: 68273 - DNA, 2807 bp, Homo sapiens
atgaaaaagaaacattgctaaatatacaatatataatcaaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaacta

SEQ ID NO: 68274 - DNA, 2351 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgttgctgtttcttttttgtcgctggagcccctgcaggtttctggtgtcttgggggtatgatgttacttgtagaggcagatactgttgcagcactgccaggtcttggggaggtgggtgggctgctcacagttttactggcatccagttcagatgaagctcctgcagttgctccctgggtcccttttccaatctgatccttctttttacccttctttcttccccggtagtaagaacgttctcgcattggcagccatctttcttgatctggggtaacttttgggtcataattcttcgccaattttcccttctttttctttttcttcttaatcaaatctccctgtccttgttcctttggttgcctacactagtgga

SEQ ID NO: 68275 - DNA, 2019 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataactttggccttccttcctcttcctcctgattatatacaacatatctcctttcaagactattatttccatcatgcttattccttcacaaatctaaaccttgaggtgatatgaacgcaaccaacatcaagtaaagcatactcaattcagacatgaagaaaactggcacggtatacaatacaccccccgagcatctcatatatcactggcacagtacgattcagtgtactgctacagcccatagataaatatggcagctagatcagctcattgttacctcttgtcgagtgcacaggtc

SEQ ID NO: 68276 - DNA, 2819 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaattgcaagccttttcacattcctttagtatacgttccattcagcattcaattagcatgcctgctatgagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaacta

SEQ ID NO: 68277 - DNA, 1321 bp, Homo sapiens
tagaaacggtgggatagtcttagcgtatgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtttatgctgtacagcataaactattttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaacta

SEQ ID NO: 68278 - DNA, 1047 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaaggctcacccttggcaggtgtgggatctgggccagcagcacaagatgagcacagcctactgggcagagtgggcagaatgagcccagcaggcatgagcaaaactccagcagaggcgctgcaggccatggaagtttccagctggtgaagcgacatcctaagaactttgtgacactatcctttcttcttggtttgcacacatggttgaggcatgaatttctagtaaactcatggtcacctccacctagccgtcaatagctactattcattaagtgcccaggcatcttacactcatcacctttaactctttactcaggcatgtggcagtgtcaccattttatagataagaccaaagccagtagctgtaaagtattaggcttgaacttagcagtagaatgaaactattttctgttca

SEQ ID NO: 68279 - DNA, 1288 bp, Homo sapiens
tgtttgcctgaactgtttgtacctctgggccatattgcagaaccctgcccttctttgttgactgaggaaagctcgctccctgcccaggtttttcattgttgatcgaaattaacaccaggtggtgaatagagcccctcctaaggttgctcaggataaatcatttattaaataggtctgcttatcaggaggggcgtgaaggctcccaaaaggaaatgctggcacctgggcccagaagccagggcctctaactcctggggttgatttcttcagtgaagttgcaccctacaaagggaatatggccaaagcggcactcaactgaaggctgatatcaggcgattagacagccatgcattctgcgtttgtctggaatggattgtagagagatggacttatatgaggactaccagtccccgtttgattttgatgcaggagtgaacaaaagctatctctacttgtctcctagtggaaattcatctccacccggatcacctactcttcagaaatttggtctgctgagaacagacccagtccctgaggaaggagaagatgttgctgccacgatcagtgccacagagaccctctcggaagaggagcaggaagagctaagaagagaacttgcaaagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgcccacccttcctccattctgagcacataaaaaccccacactcagccagactcaacactcatcaggacaacctgcctgcagaaaggaccactttgggtctcctgagtgctgttctgtcattcaataacgctcctctctgccttgctcaccctacggttgtccatgtgacttcattcttcctggacacaggacaagaactcaggacctgctgaacagcgggagcaaaaggaactgtaacatgttcctggctggcttgccaagctggggcggtgacacgctcccagactgcaggagagaagagtggtgacccttctggggacccagaccttgggattccctgagccagagctgctataacattatagccttcccacctttcaccggcaccagacagctgccccacatgacaggaggcagcagcagagccaggccagctgaggagccatgggctggagtggggtggtgggactgaaagagctgtaacacaaacgggctgaaac

SEQ ID NO: 68280 - DNA, 1187 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaata

SEQ ID NO: 68281 - DNA, 3229 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcaggaaaaaaaaaaaaaaacaaaaaaaaaaaaaaaaaaaaaaaaaaaaaaaaaaaaaaaagaaaaaaaaaaacaaaaaaaaacaaaaaaaaaaaaaaaagagaggggggcgggccagcaaaaaaaatctttcccgacggggggggcgacacaaaacaggccaccccccccaagttatttgagagaaaaggaggggcgcacccaaagggggagggggattctaaataacaaggcagggcgggggcggggataaaaaaacacaggcagagagaggagaacaaagcgcagtgactgggcgaacactatcgtagaagaaacaccaaccctctgggggcagggcacacacattaagaggacaacccactctacaccagacgaatactatgacccgcaggaagcgaacaactaaaaacaatagacagcgtgagacttgaggagggaaaccaacaacacaacaactatagtttcggtaggagagataaaaaacaactgctacgaccgaacgcatatagtagaacaaaaaatactcacacgagccgagcagaaggaagaagcgagaagaaggaaggaaggacaggacaaggaggaaagagagtacagagaacaggggagtgagcagagaagaagaagagagagagaagagcaacagaagagagaagaagaaggaaacccgacaaagaagagaacacacaaagaaagacaagatacaacaaaacacgagacaagaaagaagacatacaaaacaacaggaagaaatcagagaaaaaagaaagaaaaaagaaataaggtaaaaagaaagagagaaagaaaaaggaaagacaagatacaacacggtagagagagagacgacagaacagcagagagaagcaaagaaacataacacagagagaacagacacgagtaacgagcgaaagaaagaggagcgagagatcagacaacaaaataagataat

SEQ ID NO: 68282 - DNA, 4125 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaactaaaattcttgccagctctcatgtaattttgatgttactgaggttggttggtagtttattttattaattttgtggttcttctatcatatagaaaaagccaaatacagttttgtttgaatatttgt

SEQ ID NO: 68283 - DNA, 4071 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaattgcaagccttttcacattcctttagtatacgttccattcagcattcaattagcatgcctgctatgagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaacta

SEQ ID NO: 68284 - DNA, 4072 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcgaggagcaagcttctagcagcagaaaccgaactgctctgtcttctgtattgagagccatctgcagagctgttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaaaatgatactgtagaacctgtctcctactttgaaaactgaatgtcagggctgagtgaatcaaagtgtctagacatatttgcatagaggccaaggtattctattctaataactgcttactcaacactaccaccttttccttatactgtatatgattatggcctacaatgttgtatttgttatttattaaattgtgattgttttattattgtttatgccaaatgttaactgccaagcttggagtgacctaaagcattttttaaaagcatggctagatttacttcagtataaattatcttatgaaaaccaaattttaaaagccacaggtgttgattgttataaaataacatgctgccattcttgattgctagagtttttgttagtactttggatgcaattaaaactatgtgctatcacatgtgaaaagcttaataaattccatctatcagtagtataggtctcaatatttattatgagaccagtggtctggaaacagcttgttgtaccgaatcaactggagtctatgcttaaaaaaaaaaaatttttttttaaccatccttaaattattgcttaatggtatcatattaacatattctaaataagggctttaaggcacaggctgttgaagcattttctcagaggagtggatctgtagaagtctgtctttctatagaaatattgtgcttactcaagtgttaaattattttttctatgaactagtctacttcttaaaattcaaacatattcttttgatcacattgtttcttgagcatcctgccctgctactaacttttcaacaaggcaaaatggagtaaagtggcaatttctttagatgagtgaaataccctcaagtctcttttctgcccaaaaagggaaaagtgatagaaatgggggtggcaagtggggtgagtggatgaaggtgggtattgggggtggctgtgaaagaaaataatggagaatcacttttctagacatctacctatacttaatctaagaaacaaagtaatctactgtaaagtactctgccccttgaaagaagtattaaaaagagtgaggatggatttagaaaaaaacatgaatttagaaatattcaaaatggtttttgtggcagattcaatattatgaattcacagatatttaaagaatgagaaacatagtaattagtagaaatgccagaaacagttcctggttcctcttgtgtttgacactaagaaaatagcaagagtgtgaaatctcagatacttatgaaatctcacagatgtaaggactcaagtgtagaagaaaatatccccttcttacaaaaagaaatgtcaatttatggagtttgtgggaaatagggcaagaattcttatgcttatgagagccaagtagtcagtggaagagagtagagctcaaaactggattatcaccttagcaacttagaatagtttgaaatagaaaaaaagtatttaatttggatctggatctgttaagatatgcacagtctattttttgtatagtattggaaaataaaaatgctataatttgggtatgggttcttttgtatacattacctgcccattgaggaaaggggcaagtccattatgcaacttctctccaaacccttcatattctggatatgatacttaaagagccatgagcagctacattctgcctatcagaaggcatttattaaatgactgcttgctgaagatgtgtccaaagagatcctacattaaggtcatttgtcagaatgatgtttgtgtttgtttagagttggctgacctccaactcctggggtcaaggaatcctactgccttagcttcccaaatagctaggactataggcatgcacccggccatgtgttttatttatagctcttaaagcccagatgaagaaatcacatttttgcccatagtgaagaaacatttggccattgattagtccttattttcagtgactgtcctgttttcattagattagagagaccctgtgtgggccacagttaatataaaccattatcacttttaagtaaacctgcacatcttagatttcataatttccttattgttctgactcaaaatgaactaagagcttttcactttttgtttgtaagttctcagagagtcgggtctgcaagtgcttttgcctgccaggattttgtactcaaataaatgctatttggcaacta

SEQ ID NO: 68285 - DNA, 2017 bp, Homo sapiens
  misc_feature (1841)..(1842): n is a, c, g, or t
  misc_feature (1844)..(1844): n is a, c, g, or t
  misc_feature (1850)..(1850): n is a, c, g, or t
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatgtaatcaaacttctaggtgacttgagagtggaacctcctatatcattatttagcaccgtttgtgacagtaaccatttcagtgtattgtttattataccacttatatcaacttatttttcaccaggttaaaattttaatttctacaaaataacattctgaatcaagcacactgtatgttcagtaggttgaactatgaacactgtcatcaatgttcagttcaaaagcctgaaagtttagatctagaagctggtaaaaatgacaatatcaatcacattaggggaaccattgttgtcttcacttaatccatttagcactatttaaaataagcacaccaagttatatgactaatataacttgaaaattttttatactgaggggttggtgataactcttgaggatgtaatgcattaataaaaatcaactcatcattttctacttgttttcaatgtgttggaaactgtaatgtttnngnaactgntctaattgaaatgatgccgggggtgatgaaggtaatttggtgaggaggttcatttataaggtttaaacacttttatgttgttgggagggtggttcaaggggggtggaagaggaggggggaaaggatataaaaacggggggggtggttgacaaaaaaaatagaacgca

SEQ ID NO: 68286 - DNA, 1434 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgtgagattcctacctttgttctgctacccactgccagatgctgcaagcgaggtccaagcacatcttgtcaacatgcattgccatgaatttctaccagatgtgcttttatttagctttacatattcctttgaccaaatagtttgtgggttaaacaaaatgaaaatatcttcacctctattcttgggaaacaccctttagtgtacatttatgttcctttatttaggaaacaccattataaaaacacttatagtaaatggggacattcactataatgatctaagaagctacagattgtcatagttgttttcctgctttacaaaattgctccagatctggaatgccagtttgacctttgtcttctataatatttcctttttttcccctctttgaatctctgtatatttgattcttaactaaaattgttctcttaaatattctgaatcctggtaattaaaagtttgggtgtattttctttacctccaaggaaagaactactagctacaaaaaatattttggaataagcattgttttggtataaggtacatattttggttgaagacaccagactgaagtaaacagctgtgcatccaatttattatagttttgtaagtaacaatatggtatctgtacacgtaacccattcaggggtatgggtattattccaactttattaactttttg

SEQ ID NO: 68287 - DNA, 1322 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaaattgcaagccttttcacattcctttagtatacgttccattcagcattcaattagcatgcctgctatgagaaactccccaacttttaaatcatttgaagaaaaggtcgaaaacttaaagtctaaagtagggggaaccaagcctgctggtggtgattttggagaagtcttgaattcggctgcaaatgctagtgccaccaccacggagcctcttccagaaaagacacaggagagcctgcccacccttcctccattctgagcacataaaaaccccacactcagccagactcaacactcatcaggacaacctgcctgcagaaaggaccactttgggtctcctgagtgctgttctgtcattcaataacgctcctctctgccttgctcaccctacggttgtccatgtgacttcattcttcctggacacaggacaagaactcaggacctgctgaacagcgggagcaaaaggaactgtaacatgttcctggctggcttgccaagctggggcggtgacacgctcccagactgcaggagagaagagtggtgacccttctggggacccagaccttgggattccctgagccagagctgctataacattatagccttcccacctttcaccggcaccagacagctgccccacatgacaggaggcagcagcagagccaggccagctgaggagccatgggctggagtggggtggtgggactgaaagagctgtaacacaaacgggctgaaac

SEQ ID NO: 68288 - DNA, 655 bp, Homo sapiens
aggtggttgggtgacgccccaggaaagcgctccaggccgagggcgggcggcgccgccgcgcccgacgcctctgggggtggggacttcgcgggagtcgccggcggaggcgaggaggagctctgcgcggcgcggcgggcgatccgagccgggacgggctgcaggcgggggtgctgcagaggacacgaggcggcgggctggagacatggaccgcggcgagcaaggtctgctgagaacagacccagtccctgaggaaggagaagatgttgctgccacgatcagtgccacagagaccctctcggaagaggagcaggaagagctaagaagagaacttgcaaaggtagaagaagaaatccagactctgtctcaagtgttagcagcaaaagagaagcatctagcagagatcaagcggaaacttggaatcaattctctacaggaactaaaacagaacattgccaaagggtggcaagacgtgacagcaacatctgcttacaagaagacatctgaaaccttatcccaggctggacagaaggcctcagctgctttttcgtctgttggctcagtcatcaccaaaaagctggaagatgtaaagtatgtcctcatttttccttgctcattaagtagctgacgcaaattaaaatgttattgttgttgcatc

SEQ ID NO: 68289 - DNA, 890 bp, Homo sapiens
tgggtccagtgtttgttcctaggtgtctgctgcgataaaatgaggttgtctgtagtatttaaggagaaaagagataagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttaaaaaaaaaacaaaaaaaacaaacaacaaaacagagacccgaccaaggaaaaaaaacagaacgacaacccacaagagggggggcgcacagcataaaaaaacacccccgcgggggcgggccaaccaaacgaaagggcgccgaccccatatagtgtagaagacgaggggcgcaccacaagggagcgaccaaataaacaggcaggcgggcggccggcaataataaccgccggagcctggagaaacagaacacgacgccgagctcagcaggagaggcacccatcgaggggggacacgctgggcagcaccatgacagaaagagccggggtaaccaaggctgtcaatgagaacccgccactgtgcggacgaaaacgcccgagattcggaca

SEQ ID NO: 68290 - DNA, 824 bp, Homo sapiens
  misc_feature (679)..(679): n is a, c, g, or t
agttcggcatagaatttgggccaataaagggtgaatacaatgccacagagagcacagagccatgaaccctgttctttacctgaagcaccaagtaaaaaaaatcataaaaagaggctccccacttattgcagcactggcggcccaaaataatgataaaactgtgaagctgtggaaagtcagcgagcgtgataagaggccagaaggctacaatctgaaagatgaggagggccggctccgggatcctgccaccatcacaaccctgcgggagcctgacctgagacccatggacctaaggggcggcgcccccccacaaaaagtattcgccaacacaaaagagtaaaacgtccgcctccaaagctcggtagcagcgcactctgaagcctacgtggcccgttgacgaacctgaaggatagaccaagggaactccgaaataagcccagagagaggcgacagagatgtcacctaaaaagcagtcccgaagtcgagggagctaagccaccgcgggcataaaacgggtgaacacgggcccggaaaggagatacgacgaacgaaaaaggaaaggcaccagagtgaccacggtaacaaggagagagaacgcccgactccgggcatgacgatgccaaaacgcacaccaagcgggaatagtgtcgagcagtgtcgcgggttaggagaagtctgncacgagatgtagcagctgtcagtagaagggcagccttgaaagtcacggacatagaaggagcacagaagacgacgcaaaggaaatgggaagagcagaacaacgaatagagcacagccagagaccaagtagagggaaatcaatgccg

SEQ ID NO: 68291 - DNA, 3469 bp, Homo sapiens
cgctgccggagccgccctcccgtgggaccagcaccctcattccggccagcaagcctgaatcctgtccctgccatctcgccactgcagctcgggtccagaaaggcaccattttgtcgcggctgcccgctctcccagggggaggagggatcttttttgcattttggagcggctgccaaggaggggaacctgttgggcatctccccagacccgcttgtgagcgcctccggggcgggcgggcgggaccagacccctcggggcacggcgtatcttggcacccggaggcagcggaggcaggcgcagcatcctcgctgggaactggagctggagtgagcgcaccgcgcgggaggagccgccgcagcctcgcagaacccgagtggaggaggtgacagctccattgccgggtttttattttttttctctccgcctccccgtctcctcctcaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactcttagacaaattcttcttgttttgtgaaaaaccagaactagtcagtatctcctgcccctccaccatttttttttccattttccattttcctttgaacaatttcatttaagccagagatttattgcatgaagctgagaagaggatgcagaatgacaaggaaagggcacatcaaccctgctatgctctttttttgtaagctccatagaaacagcctgagaatttggctagggaacttgaatgcttcaggggacagaaagagagcactttcgacacagtgcttcccagagtgagcttggcagggccaggcggggccaaattccatctgctgccttgttactcttgctttttgtgctcttaaatggctccatataatcttctacttacatgttccttggcttttttctcttcaaccttttccagcttatttattccattgacttctaaaggccgagtcctgggtgcttattatctggtgttctaaatgaagcagtaagttggaagcagtgccaccacccctgagtccctgagaaaggctggtctgttctttttgggtgtttctcctaagcagcaccctcccctcctcctggttttggtaaccaaaagtaacaatccatcaacctccattgtacctagaacaaaaatagccaataaaaacgctgagttgtgaagtccaatcaggcacttctaactcaccccaagctcgccatctggaaaaacagaccagaaggcttctcttctacagaaatgaactgtggggaaatcaagcagctgtgacatgaagtgaatgaagtccacttgaagctgtggaagatggttcatccttttccccagttgaggatccagatttataacttctagaaagccatttccagaaggttctatgtggcacacccctaggaaaggcactaaatgcatgcaaaggatttataaacttaggaaagtagatgggtggagtccagaaaactggttctgggttaatatctctacatctgtcttgatgactcatttctcctaactcccatttagtgcagggtaaatggtttgagatgagagtttttcaatgaaagggaaattttctttcagtttacagatgtattagaagtcctgactttcaagtgtaatttgctttggaggagg

SEQ ID NO: 68292 - DNA, 2170 bp, Homo sapiens
agcgggcaagtccttcgtaaccactccaggacgctgccaggcctgagaagggacaaactccaattgctccagttcaaactggtcctggcctggtcaaacggaggagacagagcagtgattcacagcaggacgtggtacttgcagactgaccgtcctctcaggactcactagggtctcttctctgacgagatgatacctggaattgggacactcacccaggacacactatggtgcttcagccaagtgaaaggcactatcgagattggaaccacagaaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 68293 - DNA, 2283 bp, Homo sapiens
ggacgcgtgggtcgacccacgcgatcagcaaatcctgttcagaggagcttcagccaatgaagaggctatatcccggcttgcttgggggcttctgagtttgagctgcatgcagaaatgtaaggcagtgcttcctggcgctgatggcaaaatgggacccatctccagttattcctcgggcaccccagctttgcaaatctgggaaagaacctacataaacatattggtgatgtagccagcttaaaaggccgagagaatccttatggattcaggagactgtttttttatttagatttttattttttatttggaagatgaaatgcttctctcgttacctgccttacatcttcagacctccgaacaccatcctttcttccagctgccacacagaaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 68294 - DNA, 1996 bp, Homo sapiens
agcgggcaagtccttcgtaaccactccaggacgctgccaggcctgagaagggacaaactccaattgctccagttcaaactggtcctggcctggtcaaacggaggagacagagcagtgattcacagcaggacgtggaattgggacactcacccaggacacactatggtgcttcagccaagtgaaaggcactatcgagattggaaccacagaaggagccaagggagaacccaagacagagaatagtggcccaataatgaagcatgaattatccagatgaaaacacctatggaaataaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 68295 - DNA, 1991 bp, Homo sapiens
tgtggagtctaggatgttgaagagagctgggaggagatgccaagaacactaggctgcttcctaccatctagcttacagtccaacatgtgagtaacaccaatacaaatgaaaagccatcaaatgtgtccaatagtgaatatcatcccggcagtctctgagctaggagggagagtcctggagaggtgtttattttctgatataaaaaaggagccaagggagaacccaagacagagaatagtggcccaataatgaagcatgaattatccagatgaaaacacctatggaaataaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 68296 - DNA, 780 bp, Homo sapiens
cgctgccggagccgccctcccgtgggaccagcaccctcattccggccagcaagcctgaatcctgtccctgccatctcgccactgcagctcgggtccagaaaggcaccattttgtcgcggctgcccgctctcccagggggaggagggatcttttttgcattttggagcggctgccaaggaggggaacctgttgggcatctccccagacccgcttgtgagcgcctccggggcgggcgggcgggaccagacccctcggggcacggcgtatttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 68297 - DNA, 1981 bp, Homo sapiens
aatgcaccagccgcctcgcagcagcagcagcagcagcagcagcagcagcagcagcagcagctgcgagtgcgcgcgtgtgggtgtgagggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 68298 - DNA, 1942 bp, Homo sapiens
cgctgccggagccgccctcccgtgggaccagcaccctcattccggccaggctcggaccatggtgcagtcccactggctcccctgcccccctctcctgtgagactggctgcggggagggatcatggatacttgtctgccggcttctggttcccacgcaagtaagcctgctgtcaatggaggaggacattgatacccgcaaaatcaacaacagtttcctgcgcgaccacagctatgcgaccgaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 68299 - DNA, 2089 bp, Homo sapiens
ggacgcgtgggtcgacccacgcgatcagcaaatcctgttcagaggagcttcagccaatgaagaggctatatcccggcttgcttgggggcttctgagtttgagctgcatgcagaaatgtaaggcagtgcttcctggcgctgatggcaaaatgggacccatctccagttattcctcgggcaccccagctttgcaaatctgggaaagaacctacataaacatattggtgatgtagccagcttaaaaggccgagagaatccttatggattcaggagactgtttttttatttagatttttattttttatttggaagatgaaatgcttctctcgttacctgccttacatcttcagacctccgaacaccatcctttcttccagctgccacacagaagctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 68300 - DNA, 1983 bp, Homo sapiens
agcgggcaagtccttcgtaaccactccaggacgctgccaggcctgagaagggacaaactccaattgctccagttcaaactggtcctggcctggtcaaacggaggagacagagcagtgattcacagcaggacgtggaattgggacactcacccaggacacactatggtgcttcagccaagtgaaaggcactatcgagattggaaccacagaagatgtgccttgcttccccttcgccttctgccatgattgtaagtttcctgagacctccccagccatgcagaactctgacattatctctacggtagaattcaaccacacgggagaattactagcgacaggggacaaggggggtcgggttgtaatatttcaacgagagcaggagagtaaaaatcaggttcatcgtaggggtgaatacaatgtttacagcacattccagagccatgaacccgagttcgattacctgaagagtttagaaatagaagaaaaaatcaataaaataagatggctcccccagcagaatgcagcttactttcttctgtctactaatgataaaactgtgaagctgtggaaagtcagcgagcgtgataagaggccagaaggctacaatctgaaagatgaggagggccggctccgggatcctgccaccatcacaaccctgcgggtgcctgtcctgagacccatggacctgatggtggaggccaccccacgaagagtatttgccaacgcacacacatatcacatcaactccatatctgtcaacagcgactatgaaacctacatgtccgctgatgacctgaggattaacctatggaactttgaaataaccaatcaaagttttaatattgtggacattaagccagccaacatggaggagctcacggaggtgatcacagcagccgagttccacccccatcattgcaacaccttcgtgtacagcagcagcaaagggacaatccggctgtgtgacatgcgggcatctgccctgtgtgacaggcacaccaaattttttgaagagccggaagatccaagcaacagatcatttttctctgaaattatctcttcgatttcggatgtgaagttcagccacagtgggaggtatatcatgaccagggactacttgaccgtcaaagtctgggatctcaacatggaaaaccgccccatcgagacttaccaggttcatgactacctccgcagcaagctgtgttccctctatgaaaatgactgcatttttgataaatttgagtgtgtgtggaatgggtcagacagtgtcatcatgacaggctcctacaacaacttcttcaggatgttcgacagaaacaccaagcgtgatgtgacccttgaggcttcgagggaaaacagcaagccccgggctatcctcaaaccccgaaaagtgtgtgtggggggcaagcggagaaaagacgagatcagtgtcgacagtctggactttagcaaaaagatcttgcatacagcttggcatccttcagaaaatattatagcagtggcggctacaaataacctatatatattccaggacaaggttaactaggtggacaagttattacttaataatctcacatactgaatactagtcaaacaagtttttaaatgtttctttgggtcttcatttgatgcattgactttaatttccctatacaggaaatgattggaatagaattaaaaggagtccaacattcccagctccccagttctaagaaacttttgtcaaacccaataggtttgggacacttctgtttagaattgaaagctgccagctaacagtaattcttccatagttgacttgaacttctgatgcttttattgcccagttttctctggtgggtccagtgttttgttcctaggtgtctgctgcgataaaatgaggttgtctgtagtatttaaggagaaaagagataagttttttttaattaagcaattccatttgattgaaaaaaatcaacaaaaaataaacaccgtttactctta

SEQ ID NO: 68301 - DNA, 1207 bp, Homo sapiens
gagggagagcaaattcgcgcacctgatgtctgcttaagctacctgctagactgagactttctgcgaagccggcgtgtctgcgagcagcactcgctaaggctctgcgtttaacagacactacctttgggaaggcgcttatcacaaaaagtccctgcccttctcgcgggctcggggcgcaaacctgacaaatcgggcagccttcttgagagtgcagaaatgctctgcgtacccagcaaatacattctctccttcccaccactctgtgcaaaccctcacgccgcggctttgtgtctgtactttagccaaaacgcagaagcttatggccaccctccactcctcacccctcatccctcaccacctgcctttcaattctcggaacgagcgacgtgacacaagaggtcccaagggagcaaacctgaaagccagagcctcctgaatacacaaactgccggtgggccagatgacattagacactcctgagatacgagaagcatcacttccttcagacagagtcggtgagactatgatgtaatgagagttctccctgtgttcctcaggaaggcagcttgtgcctttctacttgaggcatcatctttgatggctaaagaattctgcagcttggccagcgcggtggcttacgcctgtaatcccaacactttgggaggccgaagcgagaggatcacttgaggtcaggaattcgagaccagcctggacaacataatgagaaatcgtctctacaaaaaaaaaaaaaaaaaaaaaaaaaaaaccacctaaaaattagctggatttggtggcgcatgtctgtagtcccagctacttgggaggctgaggtgggagaatcgcttgagcgtgggagatcacggctgcagtgatcaagccactccactccagcctgggcgacagagcaagcccctgtctcaataataataacaattttgcagcctgattgttaacgaatgttactagttacaaacttgtaataatgtggtgaagataatacctagttaatgtctgctggggtggggcaataagcttctatgtgctttacatgcataacctaaatatctcccccaaaatcctctaaaatagctatcattttctccgtttttacaaatgagcaaattttaaagcttaaaccttagagaaacttttctaagttcatatacttgggaaataaaggcaacaatttcattggaacataggtctg

SEQ ID NO: 68302 - DNA, 893 bp, Homo sapiens
agcagaccctaagggcccaggccgggccggacgccaaggcgaggcccgggacgcccttggagaacgagcgacgtgacacaagaggtcccaagggagcaaacctgaaagccagagcctcctgaatacacaaactgccggtgggccagatgacattagacactcctgagatacgagaagcatcacttccttcagacagagtcggtgagactatgatgtaatgagagttctccctgtgttcctcaggaaggcagcttgtgcctttctacttgaggcatcatctttgatggctaaagaattctgcagcttggccagcgcggtggcttacgcctgtaatcccaacactttgggaggccgaagcgagaggatcacttgaggtcaggaattcgagaccagcctggacaacataatgagaaatcgtctctacaaaaaaaaaaaaaaaaaaaaaaaaaaaaccacctaaaaattagctggatttggtggcgcatgtctgtagtcccagctacttgggaggctgaggtgggagaatcgcttgagcgtgggagatcacggctgcagtgatcaagccactccactccagcctgggcgacagagcaagcccctgtctcaataataataacaattttgcagcctgattgttaacgaatgttactagttacaaacttgtaataatgtggtgaagataatacctagttaatgtctgctggggtggggcaataagcttctatgtgctttacatgcataacctaaatatctcccccaaaatcctctaaaatagctatcattttctccgtttttacaaatgagcaaattttaaagcttaaaccttagagaaacttttctaagttcatatacttgggaaataaaggcaacaatttcattggaacataggtctg

SEQ ID NO: 68303 - DNA, 897 bp, Homo sapiens
ggcgtgctcccaggcttagaaacaaacgagcgacgtgacacaagaggtcccaagggagcaaacctgaaagccagagcctcctgaatacacaaactgccggtgggccagatgacattagacactcctgagatacgagaagcatcacttccttcagacagagtcgggtcttgctctctcacccaggctggagtagagtgacaatgaccactgcagcctccacctcctaggctcaagtgatcctcctgcttcagcacccccacaccaggcaacataacaagacccccatctctacaaaaaattaaaaaagaattatcaggtcagatcctggcagcagctgcagcggctctccttgccatctccttttcacttctggaaacatgggctcccatgtggctgtctttgatgatgtcatcaaggtgttcagtgacatgaaagtgtgcaagtcttcaacactagaaaaggtgaagaagcgcaagaagttgctgctcttctgcctgagtgagtacaagaagtacatcatccttgcggaggccaagaagatcctggtaagtaatgtggaccaaaccattgatgatccctatgccacttttgtcaagatgctgacagtaaggactgccgctacgccccttatgacgccaccaaggacagcaagaagaaggacctggtgtttatcttctgggcctctgagtctgcatccattaagagcaaaatgatctatgccagctccaaagacgtcatcaagaagcagctaggggtcagcactgtcgtcttcttggagggcaaactttgtgatcccctccagcgcccttcctggagaatctactagtcccagacctgccctcagggattgcaggctgcccccttcctgccagactggagggcctgggggaatcccag

SEQ ID NO: 68304 - DNA, 299 bp, Homo sapiens
  misc_feature (135)..(135): n is a, c, g, or t
  misc_feature (223)..(223): n is a, c, g, or t
  misc_feature (242)..(242): n is a, c, g, or t
  misc_feature (249)..(249): n is a, c, g, or t
  misc_feature (271)..(271): n is a, c, g, or t
  misc_feature (273)..(273): n is a, c, g, or t
aaggagacaaagagtagatatggtatcttggggacaaatggcacatgaaagcagatttggtgcttctttggtaaatggtttgataaccaatccctaggagataaagttaatgtgtcttttttttttttttttaancgaaggtcccttactggtcctgcttccatgagtagccgtgaccaggggaaaagggagagtttttttttttttttttttgagaaagagnctcactctgtcgcccaggntggagtntagtggcatgatctcggctcantncagcctctgcctcccaggttcaagcg

SEQ ID NO: 68305 - DNA, 5255 bp, Homo sapiens
  misc_feature (1896)..(1896): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaaaaaaaaacagttt

SEQ ID NO: 68306 - DNA, 1082 bp, Homo sapiens
cggctaggtagcgaggctgggtgttggcccatgagtttatcctcctcccaagtccctcagtgactgtgatggtctccagactgggaagtccttgcttgaggagcgcccctcgccttccgagttcacacacacccctccccagggccaccttgggagccaggacacgttgggtgtgagcactgctgctcttgctcctgccccatcccacctgagtgtcactgtgacaaagggcacagcggggaagggatgtgggaacggcttccaccccgggttgcctctggagctgggtgggtgtcagtcctcacagccattgttttccctctgcttccagtggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccaggtatgtggggttgtaggcccgttctgtgtcctgaggggctgtgatcctatcaggacaggaatccagctcggagctcctattaagatgactgttggccgggtgcagtggctcccgcctgtaatcccagcacttcaggaggtcgaagcgggcagatcatgaggtcaacagattgagaccatcatggccaacatggtgaaaccccgtctctactaaaaatacaaaaattagctgggtgtggtggcaggcacctgtagtcccagctatttgggaggctgaggcaggagaatcgcttgaacccgggaggtggaggttgcagtgagccaagatcgcgccactgcactccagcctggtgacagaacgagactacgtctaa

SEQ ID NO: 68307 - DNA, 993 bp, Homo sapiens
ggggaggggaggaaaccaaacgggcctaggagcgaggcctggggtggcgcagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagatttttttactatttaaaaagttgaccaatttcacccactgggaggtcagcgcaaaggctaacccgggggcttagaccagaacccagctcaccgcgaaaggacctcaa

SEQ ID NO: 68308 - DNA, 960 bp, Homo sapiens
tgaagatgtcgagctccacaggctgcgtgcgatcatacgattctctgttacatgttctttgtttcatttcaccaccctttaaacatggaaaacgcccattcctagcttgctggctggaatgggtgactcctgatctaggcaaaggactgtcttctgtctggtgaaaggaacaatttgttcatttttgctgccatgggccacggatctttgttttgttttctgtgctttgctgggtttgctgtaagattactttttgtacccttggtgttaccactgaacagtcccatcatttgaagacttgaaccctgtaaatgaggacttgggtggattgccactgtgtttttgaatctgtaattctagatgtagctacaaggcagttcaataaaatacaaaagagataacacagacacctgtcatcagaagaaggccctgaagcttccagtgacatttctgatcttctttcctcttccctctgtccccttcctatttctgcagcgatttgaacactcagccaagctgcggcggaagatcaccacgtatgtgtccttccccctggagctggacatgacccctttcatggcctccaggtatgtggggttgtaggcccgttctgtgtcctgaggggctgtgatcctatcaggacaggaatccagctcggagctcctattaagatgactgttggccgggtgcagtggctcccgcctgtaatcccagcacttcaggaggtcgaagcgggcagatcatgaggtcaacagattgagaccatcatggccaacatggtgaaaccccgtctctactaaaaatacaaaaattagctgggtgtggtggcaggcacctgtagtcccagctatttgggaggctgaggcaggagaatcgcttgaacccgggaggtggaggttgcagtgagccaagatcgcgccactgcactccagcctggtgacagaacgagactacgtctaa

SEQ ID NO: 68309 - DNA, 375 bp, Homo sapiens
tcggtacccttgaaatgggcacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccaaggatacatgcactcctcaatcagttctcagatgattctgcctctaagagcagcagaaactacaggtaatcatctccgggcttactgatttcgtga

SEQ ID NO: 68310 - DNA, 408 bp, Homo sapiens
cgtacccagaagactgaagactgcatagccgttaacactgatacgatggccgacaaccccaaccactgcaactgcatcatagaccagatcttcacaggcgggttgcagtcagacgtcacctgccaagtctgccagtaagtgagaggctgcgtgctcggcaatatcaaaccctctggggccgtactgacatcctcccagtctccagagctgtgtgtgctctgagaggtctttaaggaggctacgagataaatgattaatagacgccatgagagcgaaggttgtggggtgggggtgcttcctcttggggaggtcgtagggcaggtgtcccctcgggatgcgagcccttcgtgttgaggtcttggctgttgtctacagccagcagtgtgttcttggaagcttcccctacca

SEQ ID NO: 68311 - DNA, 313 bp, Homo sapiens
tcttgcatctcccttaccgctcctgtcttttttgaacgcctgtagattcaccagaccagagcacttgggcagcagcgccaagatcaagtgcagcggttgccatagctaccaggagtccacaaagcagctcactatgaagaaactgcccatcgtagcctgttttcatctcaaagtaagttttccagaaagccaactctaatggcagacttagtttttagtccacagtacggtcctcagccttttggtttgctgtgcagttacattttttataattgcagcaagcaggaagaacaccgaggaagggagggtgtga

SEQ ID NO: 68312 - DNA, 4920 bp, Homo sapiens
  misc_feature (1561)..(1561): n is a, c, g, or t
tgccctgctgcctggggagcctgggacttcggtgggcggtcccgggcgttcctgcgcgaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaaaaaaaaacagttt

SEQ ID NO: 68313 - DNA, 4811 bp, Homo sapiens
  misc_feature (18)..(18): n is a, c, g, or t
  misc_feature (25)..(25): n is a, c, g, or t
  misc_feature (1452)..(1452): n is a, c, g, or t
tcagttctggataccccnggggtantggatatcgtcgaccaggcctcgcacgagcatgcgaacggcgaagcggctcaacctgtgccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaaaaaaaaacagttt

SEQ ID NO: 68314 - DNA, 4775 bp, Homo sapiens
  misc_feature (28)..(28): n is a, c, g, or t
  misc_feature (33)..(33): n is a, c, g, or t
  misc_feature (1416)..(1416): n is a, c, g, or t
gtatataggcggtacctcagggtgcganggcgnagcggcacaatctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaaaaaaaaacagttt

SEQ ID NO: 68315 - DNA, 4706 bp, Homo sapiens
  misc_feature (1347)..(1347): n is a, c, g, or t
gtggtggacattcttcaataccgttcatgtaaaagtggcataaaaactagcagaatgcgatatctcatcgttttctggcttgaatgaatgaataaaagaaaatgagtatgtagaggtagaggaagccactgggatccagcgacacctgtggttcagcacacaggtaactcctgctctctggtgatttgtgtccaggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaaaaaaaaacagttt

SEQ ID NO: 68316 - DNA, 4448 bp, Homo sapiens
  misc_feature (1)..(1): n is a, c, g, or t
  misc_feature (52)..(52): n is a, c, g, or t
  misc_feature (1089)..(1089): n is a, c, g, or t
ntggcgacacgtagcggaatcgggggtatgctgttcgaattcataagaacangggaggttagaagtagggtcttggtgacaaaatatgttgtgtagagttcaggagagagtgcgtcatatgttgttcctaggaagattgtagtggtgagggtgtttattataataatgtttgtgtattcggctatacgtgtccggccacgtggccggacacgtatttggggagacactaatcccagagccgtggtctgtctccaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaaaaaaaaacagttt

SEQ ID NO: 68317 - DNA, 5001 bp, Homo sapiens
  misc_feature (1642)..(1642): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagtggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaaaaaaaaacagttt

SEQ ID NO: 68318 - DNA, 5099 bp, Homo sapiens
  misc_feature (1896)..(1896): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68319 - DNA, 5083 bp, Homo sapiens
  misc_feature (1896)..(1896): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatccctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68320 - DNA, 3844 bp, Homo sapiens
  misc_feature (21)..(21): n is a, c, g, or t
  misc_feature (24)..(24): n is a, c, g, or t
  misc_feature (28)..(28): n is a, c, g, or t
  misc_feature (38)..(38): n is a, c, g, or t
  misc_feature (40)..(42): n is a, c, g, or t
  misc_feature (51)..(52): n is a, c, g, or t
  misc_feature (641)..(641): n is a, c, g, or t
tggtacaacgatgtttacgtngtngtcnctacgctgtngnnngctgatcannctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68321 - DNA, 3528 bp, Homo sapiens
  misc_feature (325)..(325): n is a, c, g, or t
gtggctgatctagaggatcccagtgatcatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68322 - DNA, 3311 bp, Homo sapiens
ggaggcgggtctgtaccagacggactatactgagagcctatgacaatagccgaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggcacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68323 - DNA, 2700 bp, Homo sapiens
cacgaggaatttcagtaattcattcactttactagtattacatttatgaaattcacctttgtggaaaaaggagcgggagagggataagaaaatgcctgtttctagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68324 - DNA, 2617 bp, Homo sapiens
ggggaggggaggaaaccaaacgggcctaggagcgaggcctggggtggcgcagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68325 - DNA, 5053 bp, Homo sapiens
  misc_feature (1896)..(1896): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68326 - DNA, 5053 bp, Homo sapiens
  misc_feature (1896)..(1896): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68327 - DNA, 4800 bp, Homo sapiens
  misc_feature (1896)..(1896): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacattcatcggacggggggaatcctcta

SEQ ID NO: 68328 - DNA, 1652 bp, Homo sapiens
cggacggcgtgggtcgcccacgcgttggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68329 - DNA, 1466 bp, Homo sapiens
aaatcagctcggtaccaaaagccatttctgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68330 - DNA, 1437 bp, Homo sapiens
  misc_feature (18)..(18): n is a, c, g, or t
  misc_feature (25)..(26): n is a, c, g, or t
agccaggctggtacgccnggagtanngggaatcggcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68331 - DNA, 2341 bp, Homo sapiens
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68332 - DNA, 1249 bp, Homo sapiens
cagacatcccaggtgaagccatggtgaagctctactcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68333 - DNA, 4859 bp, Homo sapiens
  misc_feature (1896)..(1896): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtagggccggaaaaggaggccgggactcctaagggcccgggggccctagggggaaccgggctccaatcgagggaaccgggcttaa

SEQ ID NO: 68334 - DNA, 1133 bp, Homo sapiens
atctgagtccaggagtttgagaccagcctgggcaacatagcaagaccacatctatataaaacattaaaaagagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68335 - DNA, 4168 bp, Homo sapiens
  misc_feature (1896)..(1896): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagaccgccgagaagcccacaagatctgagtgaaatgagcaaaagtcacctgcccaataaagcttgacaagaca

SEQ ID NO: 68336 - DNA, 1058 bp, Homo sapiens
cggccgctccaacatcagtcaactctcctttccattagatttgttcctaattaaaaggttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68337 - DNA, 562 bp, Homo sapiens
ttcaatttctacaagcatgcaggcttggatgcgaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68338 - DNA, 1800 bp, Homo sapiens
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaaggccaactgagggtaccgaggtcgacttcggcctcccgggccc

SEQ ID NO: 68339 - DNA, 1786 bp, Homo sapiens
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaaggccacactagacgtcgctttccacctag

SEQ ID NO: 68340 - DNA, 1676 bp, Homo sapiens
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgtggggtagcactctgtttgtggaggtagcactactgtttgtggaggtagcact

SEQ ID NO: 68341 - DNA, 1529 bp, Homo sapiens
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtgaaatacatgggggtcctctagagtcagaccc

SEQ ID NO: 68342 - DNA, 1442 bp, Homo sapiens
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccagtaagtgagaggctgcgtgctcggcaatatcaaaccctctggggccgtactgacatcctcccagtctccagagctgtgtgtgctctgagaggtctttaaggaggctacgagataaatgattaatagacgccatgagagcgaaggttgtggggtgggggtgcttcctcttggggaggtcgtagggcaggtgtcccctcgggatgcgagcccttcgtgttgaggtcttggctgttgtctacagccagcagtgtgttcttggaagcttcccctacca

SEQ ID NO: 68343 - DNA, 1124 bp, Homo sapiens
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatggaagaagtacaacaacgcccaccacctcgcctcgtgcggtacagcgctcg

SEQ ID NO: 68344 - DNA, 410 bp, Homo sapiens
taggctaggtgcgaggccgggtgttggcccatgagtttatcctcctcccaagtccctcagtgactgtgatggtctccagactgggaagtccttgcttgaggagcgcccctcgccttccgagttcacacacacccctccccagggccaccttgggagccaggacacgttgggtgtgagcactgctgctcttgctcctgccccatcccacctgagtgtcactgtgacaaagggcacagcggggaagggatgtgggaacggcttccaccccgggttgcctctggagctgggtgggtgtcagtcctcacagccattgttttccctctgcttccagtggagtctccaccaccatcgaccccttctgggacatcagcttggatctccccgggcggccgcggctccccgggcggccg

SEQ ID NO: 68345 - DNA, 686 bp, Homo sapiens
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctgggtgaggcgagcttctgggatggggggatagttgtggcccccaaattgctactctttgattttttgatttgcagttccactcttccaaaagtccactttgtcgtttgtctcaagtaatgcgtgcccctcactggtgacacttggaagtgaaagggacaa

SEQ ID NO: 68346 - DNA, 449 bp, Homo sapiens
tacaatggctgaagtgggaggggtccatggtggtggacattcttcaataccgttcatgtaaaagtggcataaaaactagcagaatgcgatatctcatcgttttctggcttgaatgaatgaataaaagaaaatgagtatgtagaggtagaggaagccactgggatccagcgacacctgtggttcagcacacaggtaactcctgctctctggtgatttgtgtccaggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggaggtgagcgccattgacttctgcaggggaacatttctgttactttgttttcaccttc

SEQ ID NO: 68347 - DNA, 2933 bp, Homo sapiens
  misc_feature (808)..(808): n is a, c, g, or t
caacataggctagatgagccgcggggtatcggccgaggcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctgcaccaccgcactccagcctgggtgacagagcgagacttatctcataaataaatagatagatactccagcctgggtgacagagcgagacttatagatagatagatagatagatggatagatagatagatagatagatagatagataaacggaattggagccattttgctttaagtgaatggcagtcccttgtcttattcagaatataaaattcagtctgaatggcatcttacagattttacttcaatttttgtgtacggtattttttatttgactaaatcaatatattgtacagcctaagttaataaatgttatttatatatgc

SEQ ID NO: 68348 - DNA, 1337 bp, Homo sapiens
tcaggcatggggtcttgtgtatgttgcccaggctggccttgaacccatgggctcaagcaatcctccctccttagcctcccaagtagctgggactacaggcatgggccaccgtgcctggctctgttctttacttcagttgaagtttaaaaaccctggacatgatccaccgaaattatttcagaacccgaaatggactgtcacttctaaactgcataagacgagcaaatatcgggaaaggccagtgctgcctgtgtcacgggggccattttctataaggagcatagaccgtttggggccttgtctctgagtattagaaaccgagtttgctctgagcaatttggacctcctcgctgtcccttaactactgaattccattagtaggagattgtctcaagatttaaatcctgtataaatatcgagagtaaatttcccagtctgcaagttttcattttttatattgttaaataaatttctagcaaggaactggccttgtgaaatgcagcattgactgtccagtgcaggccaccgggcctggcctgggcacgctctgtgaaatgtgcaggggtctccagtgttgcctagggtcacaggccccaagttctagatgcagctgagatagacctgtggattcagagcctctgacagggcccatgagtttatcctcctcccaagtccctcagtgactgtgatggtctccagactgggaagtccttgcttgaggagcgcccctcgccttccgagttcacacacacccctccccagggccaccttgggagccaggacacgttgggtgtgagcactgctgctcttgctcctgccccatcccacctgagtgtcactgtgacaaagggcacagcggggaagggatgtgggaacggcttccaccccgggttgcctctggagctgggtgggtgtcagtcctcacagccattgttttccctctgcttccagtggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacggtgagaggcctgcacccacacggcgggggcgtgtctcctggccagaaggctgtgctccatcaggaccaaagcagggctctttcacatgcccaggacagagcctgggcaaaggtgcagcatgagcctggattggctgcagtctcttgtgctagtttgtcctttgttttggccagatgactcaatatttctgtcccccagcttcgcacagcaccaggtgtcagtgtcag

SEQ ID NO: 68349 - DNA, 1102 bp, Homo sapiens
  misc_feature (28)..(28): n is a, c, g, or t
  misc_feature (33)..(33): n is a, c, g, or t
gtatataggcggtacctcagggtgcganggcgnagcggcacaatctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtttccaacaaccattcgaacctttctggcacatcaagtttggatcttcccgggtctttcacccaattttggcccttaaccaagaacaaggcacacgtgcaacaggggaaagcacatgttgggatacacgagcacagaaagcctaggagaatccagaaccaaacagttggacagcaaggcccagaaacatgcagggctgtaccaagtacagcgaacccaacagctccatagtaagaaggtcgactgatcggtaccatactaaaaagaacccatccatcggtggaaaacagcagtgcaacccgagacgatacacatagcacacgaagagcagagctaacaatagtagaacagacgtagacagtacagcacgtagcagcgacatgtgcgtagactagtatacgctacaacaa

SEQ ID NO: 68350 - DNA, 4892 bp, Homo sapiens
  misc_feature (1533)..(1533): n is a, c, g, or t
taaatcagggacgaggcgaggttgtaggtctagatcgggagtccgtgagtggttgatgtgcagtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaaaaaaaaacagttt

SEQ ID NO: 68351 - DNA, 4011 bp, Homo sapiens
  misc_feature (652)..(652): n is a, c, g, or t
gaggatcccccattgtatttcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaaaaaaaaacagttt

SEQ ID NO: 68352 - DNA, 4418 bp, Homo sapiens
  misc_feature (1059)..(1059): n is a, c, g, or t
taggctaggtgcgaggccgggtgttggcccatgagtttatcctcctcccaagtccctcagtgactgtgatggtctccagactgggaagtccttgcttgaggagcgcccctcgccttccgagttcacacacacccctccccagggccaccttgggagccaggacacgttgggtgtgagcactgctgctcttgctcctgccccatcccacctgagtgtcactgtgacaaagggcacagcggggaagggatgtgggaacggcttccaccccgggttgcctctggagctgggtgggtgtcagtcctcacagccattgttttccctctgcttccagtggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaaaaaaaaacagttt

SEQ ID NO: 68353 - DNA, 4167 bp, Homo sapiens
  misc_feature (808)..(808): n is a, c, g, or t
caacataggctagatgagccgcggggtatcggccgaggcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaaaaaaaaacagttt

SEQ ID NO: 68354 - DNA, 3810 bp, Homo sapiens
  misc_feature (607)..(607): n is a, c, g, or t
gtgaactggcaccgtcgctcggcacctgcctgacgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68355 - DNA, 3435 bp, Homo sapiens
  misc_feature (232)..(232): n is a, c, g, or t
aacaaacaaaaaagcaggactatgacgagctgggtgttactcggccgaggcccatcaccaaggtcaagcatcaaggacgtctggacagcgaatgggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68356 - DNA, 2762 bp, Homo sapiens
actaggtacgaggccggcggttaatcggccgaggagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68357 - DNA, 2388 bp, Homo sapiens
tgtcagtaagcactgcactctgggactgccgagagctgattctgtccgcccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68358 - DNA, 5096 bp, Homo sapiens
  misc_feature (1896)..(1896): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctgagaaaaaaaaacagttt

SEQ ID NO: 68359 - DNA, 4940 bp, Homo sapiens
  misc_feature (1896)..(1896): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatga

SEQ ID NO: 68360 - DNA, 4511 bp, Homo sapiens
  misc_feature (1896)..(1896): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtcttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctgaactttcgtatccaagttagtcccccttattccactgtggcattgccgttctaagcagttacctgatgcctgctgctgaagagctgctcacaggaggcgggcgcagagaggggcggagcagcagagaggggcggagcag

SEQ ID NO: 68361 - DNA, 4142 bp, Homo sapiens
  misc_feature (1896)..(1896): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtctttttttttttttttttgggggagggggtttggtggcccggggtgggggttggtgggcccgtctggggtcgtgggaccttccactgtcggtggggtctcaagcatgttcctcgtgccgaagctcctcccaaagattcgctggggacataccgggatttgcgccaccagcgccggggataatcgtggtcatttcagccacagcaggtggggggtttcctcctttgtcctcaactccctgaccctgaggggattccaccccaccttagtgtccccagtgcgggtgtttatgggggtggacccccggcctggcctaggagtggccttcattgcgacctttttgtgaacgggacttgttgctttggcccagt

SEQ ID NO: 68362 - DNA, 3475 bp, Homo sapiens
  misc_feature (1896)..(1896): n is a, c, g, or t
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccnccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagatttttttactatttaaaaagttgaccaatttcacccactgggaggtcagcgcaaaggctaacccgggggcttagaccagaacccagctcaccgcgaaaggacctcaa

SEQ ID NO: 68363 - DNA, 1919 bp, Homo sapiens
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccaggtatgtggggttgtaggcccgttctgtgtcctgaggggctgtgatcctatcaggacaggaatccagctcggagctcctattaagatgactgttggccgggtgcagtggctcccgcctgtaatcccagcacttcaggaggtcgaagcgggcagatcatgaggtcaacagattgagaccatcatggccaacatggtgaaaccccgtctctactaaaaatacaaaaattagctgggtgtggtggcaggcacctgtagtcccagctatttgggaggctgaggcaggagaatcgcttgaacccgggaggtggaggttgcagtgagccaagatcgcgccactgcactccagcctggtgacagaacgagactacgtctaa

SEQ ID NO: 68364 - DNA, 1773 bp, Homo sapiens
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcagagagagcaggatgagtgggccagttaccagcagcccacggaacagtctcagcatgacacagtatttcctgtttgctgttgttaaccatccagggcttggtggagtggcctaccccggttttccggggcccagacctggtcagtgtgcggtgcctcttccaggcggtcggggtctgcgcggctgtggtctcaacgtcggtcgtcctttgggcgcaaggtcttgcc

SEQ ID NO: 68365 - DNA, 1498 bp, Homo sapiens
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaaagacgatattgaacaataagcacaatgtgcacaaggaagatcat

SEQ ID NO: 68366 - DNA, 1057 bp, Homo sapiens
gagcggagtgcggtccgcagcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgctggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtgggtggagcgtgtcgtcactctcagctaggcttctttccagggtttaaaagtaaatacagaattgtgggtttcttaagtccacatgattctgttgaagccctgcataactgtcactcatcaatgtgctcagcaaccagctcttgagcacctgttctctgcagggacctgcagtgggcttggggcgcagagtgatgcgtagcaacagccctgccctcacagccttcagcgtctgtgtgggtaaagggactcaagttgattttggccagggtgaggctgggcacagtaatcttcagggagagaaatgatgtgt

SEQ ID NO: 68367 - DNA, 326 bp, Homo sapiens
cccctcacctgctcaggataggagactccgctggactggcttccctgcttgtgaataggaaggtgctgtgaacagtcagtatctacagaacctcactgtgtttaactctgccctccagccttccattgtggtttttaattcaacttggtttctcctccctcctttctctcctcagccattgatctgatgtatggaggcatctactgttttctgtgccaggactacatctatgacaaagacatggaaataatcgccaaggaggagcagcgaaaagcttggaaaatgcaaggtttggttccacctcagtttacctgcttgatcctgca

SEQ ID NO: 68368 - DNA, 314 bp, Homo sapiens
gtcatttttatcactttggtgacggtttaatgaatacagaattgtatatctgactataattagatctgcctcacaaaagaaaaattagcagatcaacagtaggtttcagactagtaataagcattcacatcacaataacatcctcttttcaagttggcccaatacatagctttccataagacatgcacagtgggacttttcacaaacctgcttgtatccagtgactaaactgatggtgtctcattgacatttttccttttaatcatagagctagtgaggtaaagtgagacttggttaattattttaaaactctg

SEQ ID NO: 68369 - DNA, 526 bp, Homo sapiens
tgctagaagtttctggttgcctcggtcgtaacatgttggagtggaggcagcagagcaaggaatatagtagatgggctttctggtgcctccatgtcctcatccatgagatgggtctgaaagccacagtatacagggctgtggtgagggtgaagtggacaaaactcagaagggcttgaagcccatggaacacaataagtgctcaagaaatattagcggtttatgttgctagagggtgagcagctgctgctgtgttcatcccggggtcttcggagccttacacaggccctggtagaggctcacagacgtttactgaatcaaactgacttttccctcggctacgctttctctctccaattgattttcaggtcctgtcaattccacttcaaaaagtgtctcaaatgtgtgccccacctgtcctccaccatcacttctttacttcaggcctcatcattgctcccctggatgattacagcagcctcccagttggtctcagccttgtagtcttttgtctcttttctcaatccac

SEQ ID NO: 68370 - DNA, 432 bp, Homo sapiens
agagactatttttctgtcctaaagatgaggctgaaagttcccaaatgcaagacgatttttgccctgaagctaaacagcaattaaatggatgaagcaaaggacttgtttaagtcctttggctgttgtcccacagggtcatggtgctagctcaggcaaaaatggatgagcaaggacttgtttagtcctttggctgttgtccacagggggtgatagcgctcagtgttatgtgacgtcagaaggccatcatgttaaaatatagcacgatagggacaactgatcactctcttgaagtccggagctcttagaacagatggtctgtttttctgtagtaatgctcacaccatgtcttcccactcatagctcccactcactgccccttaccccaccccagcctccagtcgtcaaaatttaaagctgtaaagggaagacgtt

SEQ ID NO: 68371 - DNA, 600 bp, Homo sapiens
aaatactgacaaaagttgtcacaatcaacttctttggatggggaaattaactaaaggcttgtaacaatccaaggagtgtttaatcaagaaaaacagctgaatcttggtaagaatagcaagctttgtggcattttaacttgccatatacccatctccctcttctcagctccatgataatcttaaaagccaacagctgctcaaatcagggtgaaaaccaggcagcctagcagccattggagggagcagatcagggttaaggctcccatgtcccacagttctcacattgtcattatttgacctgtctggcacttccctttaaactcccattctaagtacttatatttatttcacctgactcagaccttgctcagtgcaagtagactttttaaaaaacctggtatttatcaaaaacaatcagcaacatttatttagcatcacagctgactgaagaggcagtaacagttgagtgagcaagaagctgactaaaaatcttaagaggataagctgaggaaggagatcccctagtgggcactagaaacttccaacatatccctgggaatctgaaaggtcatgggtctgtgtagggctgtgtgcaacggc

SEQ ID NO: 68372 - DNA, 429 bp, Homo sapiens
atggctgttttccaagcctcacgtagcaggatccttgctgtctggtccttgaggaggcctcattgactgcagacagtgcatatgtcacatctagtttgcgctgtggttgtgggagaagcggcccttctctcctatcctcctcacccttagctggctgcaatggagctgatagcatacacattttctcttttctccgtacatctcaacagtgacagtaaagattcagttaccaaagatttgacttacctatggacctgccagagcaccatgcctacaattcttatgggttgcttgaggtgactgccacctactttagcctgatcctaagcagtactatcccaggcttgaggtcattaagtgattgtctttcaagtgaaacgtgtttgtcagcgtaagcacataaggcaagcttatgttccagcagaggtt

SEQ ID NO: 68373 - DNA, 1181 bp, Homo sapiens
gttaggtcccggttgcgggacagtttttttttcttttttaaaacagacacagctactgagtgcaatgccgcctccacagaaaatcccaagcgtcagacccttcaagcagaggaaaagcttggcaatcagacaagaggaagttgctggaatccgggcaaagttccccaacaaaatcccggtggtagtggagcgctaccccagggagacgttcctgcccccgctggacaaaaccaagttcctggtcccgcaggagctgaccatgacccagttcctcagcatcatccggagccgcatggtcctgagagccacggaagccttttacttgctggtgaacaacaagagcctggtcagcatgagcgcaaccatggcagagatctacagagactacaaggatgaggatggcttcgtgtacatgacctacgcctcccaggagacatttggctgcctggagtcagcagcccccagggatgggagcagccttgaggacagaccctgcaatcctctctagcccatgtcgggaaggatgtgtgctctgacagacgtgtcagatgctggcagaagggattggttttctcctgtgtatacagtggaggagtctgagaagcagggatgcctggggtgatcagctccaaccagtggcagcagagtggtggctcttcctagtttagtttttgtgctccgtgttcttgtgtccttctaagaaaaatgtgggctgctcttgaaagttatataattatcatttttttttttttgaaacagggtcttgctctattgcctaggctggagcacagtggcatgatcttggctcactgcaacctccgcctcctgggttcaagtgattcttctgcctccaccccccgagtggctggtattacaagcacatgccaccacaccaggctaatttttgtatttttagtagagacggggtttcaccatgttggccaggctggtctcgaactcctgacctcaggtgatccacccacctcggcctcccaaagtgctgggattacaggcgtgagccactgcatccagccatataaccgtattctaaataagaaatggttggcttgtgtgatggttttgtgtaatgagctagagataatattttaagtgtcttctgtggtatatgtgggagggccattaaggagtgggtttcactccctgcatgtgggcaggtgtcc

SEQ ID NO: 68374 - DNA, 542 bp, Homo sapiens
gttaggtcccggttgcgggacagtttttttttcttttttaaaacagacacagctactgagtgcaatgccgcctccacagaaaatcccaagcgtcagacccttcaagcagaggaaaagcttggcaatcagacaagaggaagttgctggaatccgggcaaagttccccaacaaaatcccggtggtagtggagcgctaccccagggagacgttcctgcccccgctggacaaaaccaagttcctggtcccgcaggagctgaccatgacccagttcctcagcatcatccggagccgcatggtcctgagagccacggaagccttttacttgctggtgaacaacaagagcctggtcagcatgagcgcaaccatggcagagatctacagagatgcatccagccatataaccgtattctaaataagaaatggttggcttgtgtgatggttttgtgtaatgagctagagataatattttaagtgtcttctgtggtatatgtgggagggccattaaggagtgggtttcactccctgcatgtgggcaggtgtcc

SEQ ID NO: 68375 - DNA, 1272 bp, Homo sapiens
  misc_feature (2)..(3): n is a, c, g, or t
gnnagaacgtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaagtttaatgatgagaaaaaattgatgagctttcatcaaaatcttcaggatgtcacagaagatcaactcagtttggcctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcagctgaggcagaactcaaaagcttgatggacaatgcttcttcatcctttgaatttgctaaagaactcatcaggcacaatctggttgttttccgaggaggtgaaggggctttgcaggttttacctcccctagttgatgtcattcctgaagctaggctaaacttggtgatttactaccttcgtcaagatgatgtacaagaagcttataacttaattaaggatctggaacctactactcctcaggagtatattctcaaaggagtggtcaatgcagcccttggccaggaaatgggttcagtgagtatgaaatcactgataatctataggttgcaaagttataagtgtatggaagagaacaaaatgactatcaaagtgcaagcagcaataggctctcctgtagctccttttatttctccatatcccccaatccagactccactgagaaaagaatgttatgttatttagagacaaaaaaaaaaaa

SEQ ID NO: 68376 - DNA, 2694 bp, Homo sapiens
  misc_feature (2)..(3): n is a, c, g, or t
gnnagaacgtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaaggagaaatgaagtagaagacaaagaacctaagggaaataggaagaagagagagacacaatggctaaagaaggaagagttaaaatctctatcacatagatattgatttctctaacaacactaatatgaatctttacatgtcttttccactctcacaattttagtttaatgatgagaaaaaattgatgagctttcatcaaaatcttcaggatgtcacagaagatcaactcagtttggcctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcagctgaggcagaactcaaaagcttgatggacaatgcttcttcatcctttgaatttgctaaagaactcatcaggcacaatctggttgttttccgaggaggtgaaggggctttgcaggttttacctcccctagttgatgtcattcctgaagctaggctaaacttggtgatttactaccttcgtcaagatgatgtacaagaagcttataacttaattaaggatctggaacctactactcctcaggagtatattctcaaaggagtggtcaatgcagcccttggccaggaaatgggttcaagggatcatatgaaaattgcccagcagttcttccagttggtgggaggatcagctagtgaatgtgatacaataccagggaggcagtgcatggcttcctgtttcttcctgcttaagcaatttgatgatgttttgatttacctcaactcatttaagagttacttctataatgatgacatctttaactttaattatgcccaagccaaagctgcaacaggcaataccagtgagggcgaagaggcgttcctcttgatccaaagtgagaagatgaaaaatgattacatttacctcagctggttagctcggtgctatattatgaataagaaaccaagactagcctgggaactttatcttaagatggaaacctccggcgagtccttcagtctcttacagctcattgctaatgactgctacaagatgggccagttttactattctgccaaagcttttgatgtccttgagaggctggatcctaaccctgaatattgggaaggcaaacggggtgcctgtgtgggcattttccagatgatcatagctgggagagaacccaaagagacccttcgagaagtgctccatttactgagaagcacaggtaacacccaagtagaatacatgatccggatcatgaagaaatgggccaaagaaaacagagtgtccatctaaaatagcgccagcgtcctaggaaccagcttctactttgacataaaactggaaatcattttcactccagtttaatctgtgatacagggctctgttttattgacattttccttccttgctctttaagcctcaaggtcagagactgacttgctgagacttagtctcctggctgaacagagtgccatagtctgtgaccctgtatgatcctagtagcaataagattttggacttatctggtgcctttcttccaaaaatgctcagagtacttttatgcaatttactgactttaaggaaaacagtataacttttttttgttagcattttatggcattgtctcctggctgcaataacaaacatctttgatgttcaagaatcagcatcattgtatcatttaactttaaggcgtctctgtacgttatcccattttattggggaattccataaagggttttataacgtcatctctgaatcttgggagaataactagctatgtgtttctaagaaaggcagtaagctactttatcaaactgtccagtcattaataggatagatttatgggattactctttcagtaattaaattgttgatgataataacatgttacagcgcagtaagatgagtattgcaatgttttaaaaggtgagtactatgaaaaaaattgtagtacctctaaaggtattcaagaaacaatgtttatgaatctcactagtccattatagtttggtaccataattattttaggtaacaaagcaggttaggtttttgttaatgtatcttgcttaacaaac

SEQ ID NO: 68377 - DNA, 1525 bp, Homo sapiens
tgctgatacaatcagctctgtaccctcaggagtatattctcaaagggagtggtcagcagccctggccaggaaatgggtcaagggatcatatgaaaattgcccagcagttcttccagttggtgggaggatcagctagtgaatgtgatacaataccagggaggcagtgcatggcttcctgtttcttcctgcttaagcaatttgatgatgttttgatttacctcaactcatttaagagttacttctataatgatgacatctttaactttaattatgcccaagccaaagctgcaacaggcaataccagtgagggcgaagaggcgttcctcttgatccaaagtgagaagatgaaaaatgattacatttacctcagctggttagctcggtgctatattatgaataagaaaccaagactagcctgggaactttatcttaagatggaaacctccggcgagtccttcagtctcttacagctcattgctaatgactgctacaagatgggccagttttactattctgccaaagcttttgatgtccttgagaggctggatcctaaccctgaatattgggaaggcaaacggggtgcctgtgtgggcattttccagatgatcatagctgggagagaacccaaagagacccttcgagaagtgctccatttactgagaagcacaggtaacacccaagtagaatacatgatccggatcatgaagaaatgggccaaagaaaacagagtgtccatctaaaatagcgccagcgtcctaggaaccagcttctactttgacataaaactggaaatcattttcactccagtttaatctgtgatacagggctctgttttattgacattttccttccttgctctttaagcctcaaggtcagagactgacttgctgagacttagtctcctggctgaacagagtgccatagtctgtgaccctgtatgatcctagtagcaataagattttggacttatctggtgcctttcttccaaaaatgctcagagtacttttatgcaatttactgactttaaggaaaacagtataacttttttttgttagcattttatggcattgtctcctggctgcaataacaaacatctttgatgttcaagaatcagcatcattgtatcatttaactttaaggcgtctctgtacgttatcccattttattggggaattccataaagggttttataacgtcatctctgaatcttgggagaataactagctatgtgtttctaagaaaggcagtaagctactttatcaaactgtccagtcattaataggatagatttatgggattactctttcagtaattaaattgttgatgataataacatgttacagcgcagtaagatgagtattgcaatgttttaaaaggtgagtactatgaaaaaaattgtagtacctctaaaggtattcaagaaacaatgtttatgaatctcactagtccattatagtttggtaccataattattttaggtaacaaagcaggttaggtttttgttaatgtatcttgcttaacaaac

SEQ ID NO: 68378 - DNA, 462 bp, Homo sapiens
tgtgtttatctggtataactgatggttatattttatatgttaattctcagtgtgacctgttcttgggatgtttttcagagttacttctataatgatgacatctttaactttaattatgcccaagccaaagctgcaacaggcaataccagtgagggcgaagaggtgggtatctgcttttgagagcatttgaatgattctatctaaaaacatccttatctttttctcactggaataaaatggtcaagggttaaggattattaaagattcctctgttcttaggatgcatgaataagtacactgtggagaaggtgcagtgacacacacctgtagtcccagctacttgggaggctgaggcaggacaatggcttgagcctggaagttttaagctgcagtgcactatgatcgtgcctgtgaatagccactacactccagcctgggcaacatagcaagaccctgtctctt

SEQ ID NO: 68379 - DNA, 549 bp, Homo sapiens
aattattatatcaacattttacttttttttccatagaattgaaataaaatgaaacttatctgctggagcttccactaaattatttttgcttaagattgagaatttacaaatatggtaaattttgttatatagatacttggctgctggaaactaaatgagtgtctcctaattcttttattcaagccagggatagaacagagaaaagtaactgtgggtaatctttgatactttatataaagtattgagttaatgcaaggagttaatttgaaaatgatctcatagctccacattcctcttaatcagtgttattccatgtttctaggagtatattctcaaaggagtggtcaatgcagcccttggccaggaaatgggttcagtgagtatgaaatcactgataatctataggttgcaaagttataagtgtatggaagagaacaaaatgactatcaaagtgcaagcagcaataggctctcctgtagctccttttatttctccatatcccccaatccagactccactgagaaaagaatgttatgttatttagagaca

SEQ ID NO: 68380 - DNA, 2533 bp, Homo sapiens
  misc_feature (2)..(3): n is a, c, g, or t
gnnagaacgtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaagtttaatgatgagaaaaaattgatgagctttcatcaaaatcttcaggatgtcacagaagatcaactcagtttggcctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcagctgaggcagaactcaaaagcttgatggacaatgcttcttcatcctttgaatttgctaaagaactcatcaggcacaatctggttgttttccgaggaggtgaaggggctttgcaggttttacctcccctagttgatgtcattcctgaagctaggctaaacttggtgatttactaccttcgtcaagatgatgtacaagaagcttataacttaattaaggatctggaacctactactcctcaggagtatattctcaaaggagtggtcaatgcagcccttggccaggaaatgggttcaagggatcatatgaaaattgcccagcagttcttccagttggtgggaggatcagctagtgaatgtgatacaataccagggaggcagtgcatggcttcctgtttcttcctgcttaagcaatttgatgatgttttgatttacctcaactcatttaagagttacttctataatgatgacatctttaactttaattatgcccaagccaaagctgcaacaggcaataccagtgagggcgaagaggcgttcctcttgatccaaagtgagaagatgaaaaatgattacatttacctcagctggttagctcggtgctatattatgaataagaaaccaagactagcctgggaactttatcttaagatggaaacctccggcgagtccttcagtctcttacagctcattgctaatgactgctacaagatgggccagttttactattctgccaaagcttttgatgtccttgagaggctggatcctaaccctgaatattgggaaggcaaacggggtgcctgtgtgggcattttccagatgatcatagctgggagagaacccaaagagacccttcgagaagtgctccatttactgagaagcacaggtaacacccaagtagaatacatgatccggatcatgaagaaatgggccaaagaaaacagagtgtccatctaaaatagcgccagcgtcctaggaaccagcttctactttgacataaaactggaaatcattttcactccagtttaatctgtgatacagggctctgttttattgacattttccttccttgctctttaagcctcaaggtcagagactgacttgctgagacttagtctcctggctgaacagagtgccatagtctgtgaccctgtatgatcctagtagcaataagattttggacttatctggtgcctttcttccaaaaatgctcagagtacttttatgcaatttactgactttaaggaaaacagtataacttttttttgttagcattttatggcattgtctcctggctgcaataacaaacatctttgatgttcaagaatcagcatcattgtatcatttaactttaaggcgtctctgtacgttatcccattttattggggaattccataaagggttttataacgtcatctctgaatcttgggagaataactagctatgtgtttctaagaaaggcagtaagctactttatcaaactgtccagtcattaataggatagatttatgggattactctttcagtaattaaattgttgatgataataacatgttacagcgcagtaagatgagtattgcaatgttttaaaaggtgagtactatgaaaaaaattgtagtacctctaaaggtattcaagaaacaatgtttatgaatctcactagtccattatagtttggtaccataattattttaggtaacaaagcaggttaggtttttgttaatgtatcttgcttaacaaac

SEQ ID NO: 68381 - DNA, 1197 bp, Homo sapiens
  misc_feature (2)..(3): n is a, c, g, or t
  misc_feature (1197)..(1197): n is a, c, g, or t
gnnagaacgtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggagttcaaacgtcatgttggggaagaagaagaggatactaatttgtggattggatattgtgcctttcacctgggtgactacaagagagctctggaggaatacgaaaatgctacaaaagaggaaaattgtaattctgaagtctgggtgaacctagcttgcacctacttctttcttgggatgtataaacaagctgaagcagctggatttaaagcttcaaaaagccgactccaaaaccgcctcctcttccacttggctcacaagtttaatgatgagaaaaaattgatgagctttcatcaaaatcttcaggatgtcacagaagatcaactcagtttggcctcaatccactatatgcgatctcactaccaagaagctatagatatatataagcgaatactgctagataacagggaataccttgcccttaatgtttatgtggccctctgctactacaagttggattactatgatgtgtctcaagaagttttggctgtttaccttcagcaaattcctgatagtaccatcgcactcaatcttaaagcctgtaaccattttcgcctttacaatggcagagcagctgaggcagaactcaaaagcttgatggacaatgcttcttcatcctttgaatttgctaaagaactcatcaggcacaatctggtgaataacgatttcccgtcttgactgagttcagtcctactctgctttggtacatcacagcaattagaaagattaataaaaggagatgcgccagcaagtaatgctttactccaagggaacccctcctcactgtggaggagataagttttaaagtactaatctgtttccttaaggaaatccttgttgggagaacaggaatatatttaatatttggaaagaagcacaaggcagtgtagatccaggtgtctgtttttttgagaaagacaaaggaacgtatccctctgtggtttaaaataaatgggaaatatttttgcatctttgn

SEQ ID NO: 68382 - DNA, 573 bp, Homo sapiens
  misc_feature (2)..(3): n is a, c, g, or t
gnnagaacgtgctgtgtggatgcggcgaaacgctgaggcgcggccttcgctgtgtggtggggactcacaagaccgacgtcaagatgatgctttcaagggccaaacctgctgtaggcagaggcgtacagcacactgacaaaagaaagaagaaaggtaggaagattccaaaactagaggagctactttcaaaaagagatttcactggagctattaccctgttggagttcaaacgtcatgttggggaagaagaagaggatactaatttgtggattggatattgtgcctttcacctgggtgactacaagagagctctggagcgaatacaaaaatgctacagtcgagagaaagagcttatgggttacaccggatgagccaatgaagcacgttcaaagatggatgtagcccagacaaaacttgatatctatctcagtcggcataatactgcagtgtctcaattaactaaggctaaggaagctctaattgcagcttctgagactctcaaagaaaggaaagctgctatcagagatatagaaggaaaactccctcaaactgaacaagaattaaaggagaaag

SEQ ID NO: 68383 - DNA, 1510 bp, Homo sapiens
ccctggaagctgcttcctcagacatgccgctgctgctactgctgcccctgctgtgggcaggtgagtggctgtggggagaggggttgtcgggctgggccgagctgaccctcgtttccccacaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccgaaacaccagaagaactccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaaccctcaagagcatcaggctcagctagaagatccacatcctctacaggtcggggaccaaaggctgattcttggagatttaactccccacaggcaatgggtttatagacattatgtgagtttcctgctatattaacatcatcttgagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacaccag

SEQ ID NO: 68384 - DNA, 1448 bp, Homo sapiens
ccctggaagctgcttcctcagacatgccgctgctgctactgctgcccctgctgtgggcaggggccctggctatggatccaaatttctggctgcaagtgcaggagtcagtgacggtacaggagggtttgtgcgtcctcgtgccctgcactttcttccatcccataccctactacgacaagaactccccagttcatggttactggttccgggaaggagccattatatccggggactctccagtggccacaaacaagctagatcaagaagtacaggaggagactcagggcagattccgcctccttggggatcccagtaggaacaactgctccctgagcatcgtagacgccaggaggagggataatggttcatacttctttcggatggagagaggaagtaccaaatacagttacaaatctccccagctctctgtgcatgtgacagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccgaaacaccagaagaactccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaaccctcaagagcatcaggctcagctagaagatccacatcctctacaggtcggggaccaaaggctgattcttggagatttaactccccacaggcaatgggtttatagacattatgtgagtttcctgctatattaacatcatcttgagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacaccag

SEQ ID NO: 68385 - DNA, 1067 bp, Homo sapiens
ccctggaagctgcttcctcagacatgccgctgctgctactgctgcccctgctgtgggcagacttgacccacaggcccaaaatcctcatccctggcactctagaacccggccactccaaaaacctgacctgctctgtgtcctgggcctgtgagcagggaacacccccgatcttctcctggttgtcagctgcccccacctccctgggccccaggactactcactcctcggtgctcataatcaccccacggccccaggaccacggcaccaacctgacctgtcaggtgaagttcgctggagctggtgtgactacggagagaaccatccagctcaacgtcacctatgttccacagaacccaacaactggtatctttccaggagatggctcagggaaacaagagaccagagcaggagtggttcatggggccattggaggagctggtgttacagccctgctcgctctttgtctctgcctcatcttcttcatagtgaagacccacaggaggaaagcagccaggacagcagtgggcaggaatgacacccaccctaccacagggtcagcctccccgaaacaccagaagaactccaagttacatggccccactgaaacctcaagctgttcaggtgccgcccctactgtggagatggatgaggagctgcattatgcttccctcaactttcatgggatgaatccttccaaggacacctccaccgaatactcagaggtcaggacccagtgaggaaccctcaagagcatcaggctcagctagaagatccacatcctctacaggtcggggaccaaaggctgattcttggagatttaactccccacaggcaatgggtttatagacattatgtgagtttcctgctatattaacatcatcttgagactttgcaagcagagagtcgtggaatcaaatctgtgctctttcatttgctaagtgtatgatgtcacacaagctccttaaccttccatgtctccattttcttctctgtgaagtaggtataagaagtcctatctcatagggatgctgtgagcattaaataaaggtacacatggaaaacaccag

SEQ ID NO: 68386 - DNA, 3413 bp, Homo sapiens
taagaatatgtatttataatcccagcactttgggaggccaacgcaggcggatcactcctgacctcatgtgatctgcctgcctcagcctcccaaagtactgggattacaggcatgagctaatttttttttttttttttaattaaaggaagacataggccaaggagccagacttcctgtgttaactccttcctctgccactttttaccttggggacctcagttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatccaaatctgtt

SEQ ID NO: 68387 - DNA, 3319 bp, Homo sapiens
cgagtgcgcaagcgcagcgcaccgagtggacattttggtctttgtccgcgggaagacataggccaaggagccagacttcctgtgttaactccttcctctgccactttttaccttggggacctcagttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatccaaatctgtt

SEQ ID NO: 68388 - DNA, 3528 bp, Homo sapiens
cgagtgcgcaagcgcagcgcaccgagtggacattttggtctttgtccgcgggtcagtacggcccctgggtccacgtggcgcgaaagtaggaggaagacataggccaaggagccagacttcctgtgttaactccttcctctgccactttttaccttggggacctcagagatggggtcttgccatgttgcctaggctggtcttgaacttctgagctcaagtgatcctgcccacctcagcttcccaaagtgctgggattagtggcatgagccactgcgtccagcccacggtaacatttctccctgtgtcttcagcagcagtaatagtctgacaactgttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatccaaatctgtt

SEQ ID NO: 68389 - DNA, 3245 bp, Homo sapiens
cgagtgcgcaagcgcagcgcaccgagtggacattttggtctttgtccgcggttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatccaaatctgtt

SEQ ID NO: 68390 - DNA, 3356 bp, Homo sapiens
cgagtgcgcaagcgcagcgcaccgagtggacattttggtctttgtccgcgggtcagtacggcccctgggtccacgtggcgcgaaagtaggaggaagacataggccaaggagccagacttcctgtgttaactccttcctctgccactttttaccttggggacctcagttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaataagccatgtctatttatattaacccgcgctcggtgggggtgcggtcggctg

SEQ ID NO: 68391 - DNA, 3299 bp, Homo sapiens
cgagtgcgcaagcgcagcgcaccgagtggacattttggtctttgtccgcgggtcagtacggcccctgggtccacgtggcgcgaaagtaggaggaagacataggccaaggagccagacttcctgtgttaactccttcctctgccactttttaccttggggacctcagttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaatttatcgccgtgaattagccatctcggaagggacc

SEQ ID NO: 68392 - DNA, 727 bp, Homo sapiens
cgagtgcgcaagcgcagcgcaccgagtggacattttggtctttgtccgcgggtcagtacggcccctgggtccacgtggcgcgaaagtaggagagatggggtcttgccatgttgcctaggctggtcttgaacttctgagctcaagtgatcctgcccacctcagcttcccaaagtgctgggattagtggcatgagccactgcgtccagcccacgttaatatgatcctctgttgaagcaagaagacaaactgtatggtggagaaagaagtgggaaggatctgcgcgggtgagtaaatgacaggcaggccacagtttttcagtcagcattgagtcctctgaagtgcttcaaaggatgttttcttccaggctgtagacatatagagtattgcttggtatgagatttttagattcctgaatgacgcttccagtcatcatttttgtgtgtttcattattcttcttgtttcaccagattctagaggggccaggcgcccctcctgttgctgttctgacgtcagccttcctgcttcgtctgtgccgccactgtggtggctgttctccttcatccacataccttttcctgtcctcacacattgtcctttatactttgtaaaaccttacatattgtctgatattcaggttcctttttgttactaccttctctcatcctttctagtggctgaatgcctcagaattatattttacacctgttctcacacttcccgttgtct

SEQ ID NO: 68393 - DNA, 992 bp, Homo sapiens
cgagtgcgcaagcgcagcgcaccgagtggacattttggtctttgtccgcgggtcagtacggcccctgggtccacgtggcgcgaaagtaggaggaagacataggccaaggagccagacttcctgtgttaactccttcctctgccactttttaccttggggacctcagagatggggtcttgccatgttgcctaggctggtcttgaacttctgagctcaagtgatcctgcccacctcagcttcccaaagtgctgggattagtggcatgagccactgcgtccagcccacggtaacatttctccctgtgtcttcagcagcagtaatagtctgacaactggcaagttcccatttctgttctagccctattctgagctcctgatctgtatatccaactgcctaatcgatctctctgcctgcatgtgttcagaaacctacactctgaatgtatagagtctcaaacttgatctccctcctgcaagttgcttccagccaactcaccttctcgtgtttctgtcatgtatgtttcggtttaaatcatgctctaagccttatatctctgacacaccccattaggaattgggtgatcaagctttttcaacatacatagtggatggggggtatatatgtgaaacttaaattttttatgattatgcttttttatatgattacaactttatagaagagttggaatagtacagagaagtcccatgtatcctttacccaatttcaccaatcatttacattttggttgttttatttttccttctctctttctccaaatgtgtatgatttttttttcctgaacgatttgaaaccagttgtggacatgcttcctttatctataaatacttcagcatgcattttgcaagaacaaaaacattctttttcataactacagtacagtgatcaaaatcgggaagtttaacattgatacattagtattatttaatccaaagtccatattcaaatttggtcagtcatcccaataatgtctg

SEQ ID NO: 68394 - DNA, 612 bp, Homo sapiens
taagaatatgtatttataatcccagcactttgggaggccaacgcaggcggatcactcctgacctcatgtgatctgcctgcctcagcctcccaaagtactgggattacaggcatgagctaatttttttttttttttttaattaaaggaagacataggccaaggagccagacttcctgtgttaactccttcctctgccactttttaccttggggacctcagttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagctcatcagggacagcttcttctaagggatccactggaccctaggaaaa

SEQ ID NO: 68395 - DNA, 3360 bp, Homo sapiens
cgagtgcgcaagcgcagcgcaccgagtggacattttggtctttgtccgcgggtcagtacggcccctgggtccacgtggcgcgaaagtaggaggaagacataggccaaggagccagacttcctgtgttaactccttcctctgccactttttaccttggggacctcagttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatccaaatctgtt

SEQ ID NO: 68396 - DNA, 3286 bp, Homo sapiens
cgagtgcgcaagcgcagcgcaccgagtggacattttggtctttgtccgcgggtcagtacggcccctgggtccacgtggcgcgaaagtaggagttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatccaaatctgtt

SEQ ID NO: 68397 - DNA, 3406 bp, Homo sapiens
cgagtgcgcaagcgcagcgcaccgagtggacattttggtctttgtccgcgggtcagtacggcccctgggtccacgtggcgcgaaagtaggagagatggggtcttgccatgttgcctaggctggtcttgaacttctgagctcaagtgatcctgcccacctcagcttcccaaagtgctgggattagtggcatgagccactgcgtccagcccacgttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcataaaactcagtactatctattggtaatggatgcatatatgtatgtacatgtttttgaaacggattggaaggatacagaccaaactcttgatagtggtcacctgtgaagagtggagaagggaaaataatgagtgtgggaggtgggatgggtattggttaaaggggacttcagctttttatataaacatccacttctctttcaaaagacttcaagtaaatataagaagatactgattgattctggattgtggtatagggatatcttgtcttattttttgtacttttctgtatttttaaaatttctcaaaataggaatgggagtgaggatgggaatgctgtatctgtggaagtcatgttatactggattcatttccaattaaatactaaacattttatagaaaatatttctaaaattttatcacggatgaatggatggacttgctctctatgtaatatgaaattaatctattttattaaaatttaaaaggacagcacaatccaaatctgtt

SEQ ID NO: 68398 - DNA, 2854 bp, Homo sapiens
cgagtgcgcaagcgcagcgcaccgagtggacattttggtctttgtccgcgggtcagtacggcccctgggtccacgtggcgcgaaagtaggaggaagacataggccaaggagccagacttcctgtgttaactccttcctctgccactttttaccttggggacctcagttaatatgatcctctgttgaagcaagaagacaaactgtatggtggagaaagaagtgggaaggatctgcgcggaagaagcctgagaagatgatgcacagatagagaggcaccaggacttgagaggcaccaggacttgggaggcatgttgatccatctccaggaaagactgagaaaaagagcgttgaatataagaaaaaatacttcctctgttctcagatcgtatttgttttaaggccacacctttttgaagttttcagtttgaaacacaacctggactgaaatcatgagggaggttgtgtaggaaagaatcatcaagggacttagttgggagcttctctaccacagcttactccttatggtattaaccccctttaagtgtaaatgtctttggtttaaaacgtttgtacctcatctgttaccagagtgttcatactggagagaaaccctatgaatttactgaatgtgggggaactgttactcatatgttgcatttcgtcgaacgtgcaagtcatgctgaagagaaaccctgtgcttctaaggagtattgacaagcccttagctagatgacaatctcattgagaagcagaaaattcatgctggagagaaactagtgaaggtagcaatacttcattgaatattagaaaatttttctagagagaaagcattgaatatactgagtatgataacatttcctctcaaaccttatcccttactctgcatttgggagatcatacacagagaagccttataaatgtaagagatgtggaaatatcttcagccaaaagtaaatcctcactcatcaagaaatttttactggagagaaaccttgtgaatgtgggaaagcttccattcagatgtcacacctcagccagcagaaaatttacagtggggaaaacccctttgcctgtaaggtatgtggaaaagtcttcagccacaaatcaaacctcactgagcatgagcattttcacacgagagagaaaccttttgaatgtaacgagtgtggaaaagcctttagccaaaagcagtatgtcattaaacatcagaacacccatactggcgagaagcttttcgaatgtaatgaatgtggaaaatcatttagccagaaggaaaacctccttacgcaccagaaaattcacactggagaaaaaccttttgagtgtaaagattgcgggaaagctttcattcagaagtcaaacctcatcagacaccagagaactcacacaggagagaagccctttgtatgtaaggagtgtggaaaaaccttcagtggcaaatccaaccttactgagcatgagaaaatccatattggagagaagccttttaaatgtagtgaatgtggaacagcctttggccagaagaagtacctcataaaacatcagaacattcacactggagagaaaccctatgaatgtaacgaatgtggaaaagccttctctcagcgaacatcacttattgtacatgtgaggattcattcaggtgataaaccttacgaatgcaatgtttgtggaaaagccttctctcagagctcatctctcactgtgcatgtgagaagccatacaggggagaagccctatggttgtaatgaatgtgggaaagctttctctcagttctcaacccttgctctgcatttgagaatacacacaggtaagaagccttatcagtgcagtgaatgtgggaaagctttcagccagaagtcacaccacattagacaccagaaaattcatactcactaaaaaccccatgaaagccttgaaagtgggaaagctttcattagaaatttgcacctcatcatgccccagaaataatccttctgaagcaaagcaccacgaatgaggttaactttaacaagtactaaaaacttaagggacaccagaaaatttgtactgaagagaaagacatgcatatgattaaaaccctgtgtccaacagagaaacctgcagcagagataatggtgaaagtttaggcacattttcactaaaagtgggaacagaaaatggaggcctgttttttattgctaccaccatagatctggagatcttcgccagtaacaagaaaaattaagttgtaaatattggaaaggaacagacaaaaatagatgacatggtcatctacaactaatattaagactcctgtggtattgattgagcagagcagaagagatttcaaaaaaagacctatgcatttattagaatttggaatatgatacaagtggcatcaggaaatgaggaaataatggaactattttttttaagtggaggtagtttgttctccaagggggaaaaatagaccatgaactatacacaaaagtgaatccagagattaaaaacagaaatatggaaaagctatgtactaaaatgcatatgaccttgggaatagggaaacattccttggaacaatttgagaaatacttagcggttctacttatgagtatgaatgctcaggaaatacgcactaggatatttactgtggcttgatttgtagtagccaaaaattagaaacaactgagaaagcccatcacgaacaatatgggaaattcttatgtaatactatatatctgtaaaatgcaacaaatgaaatccacatgtattaacagaaagatcccagaattgttgaggggggatcaagttgcagaatgatacagatagtacaatgacttttttgtaaatttgaattaaaagtttcctcata

SEQ ID NO: 68399 - DNA, 3890 bp, Homo sapiens
actcgggtttctgtgtaaacttggccgcggttgccgcaggaaggctagccagagggtaattacacagcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgctcaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcagcacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttaatacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagta

SEQ ID NO: 68400 - DNA, 4032 bp, Homo sapiens
actcgggtttctgtgtaaacttggccgcggttgccgcaggaaggctagccagagggtaattacacaggtgaggcccggcggggcgggcggagggctcgggaggcgcaggggactggaagagttggctgcgcccaggcaccaggtggaagaatttccataccagccctgcggaggtgcctctgtttccagaggcgtttttgtacgaagggcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgctcaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcagcacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttaatacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagta

SEQ ID NO: 68401 - DNA, 1794 bp, Homo sapiens
actgaagaattgactttatttttggccaaggcttactttcctacacttgtgactttttacatgcccgaagaccaataaattacttgcttcttcatttcccctctccctcaagatacatgggaagggtcctattaccttcctttatttcctttttagttaggaacttctttcttttattcctatatcttaatagtaattttgagtgctgtggccattgatgttatatattctttatagcgacatcaccaggaggaacagtaaaatgtttccttaggggtagaaacatagaatgtatctctattaattcaatatgaatgtttttccatagaaatagaattctgaaattttaataaattacatgagttattcttattttagtcttttatgtacatatgcatcagtttgtactcaatttgtcttcttttatttcaagggtgtgattactttagagtcccttggtaaaaggggttatcgagtacctccttcaggaacaatacaagtggtatgtgttttatagcctacaattgcaataatcattctctcacatacatatagaacttagccctttctcctgctactgctgctgcaacaactttgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattcaaaaaaaactaaaaaaaatgta

SEQ ID NO: 68402 - DNA, 1472 bp, Homo sapiens
gctgattatagcagttttttatcatctaccccaaatcatgggaggctaagctgtgtgaaatgggtcagtctatggtagctagaaagatgccagtggctacatgagcccaaatgtaatgttattgagtaatgtgagtgaactgccacgtgaacctgcagatgaggaaaggtgcatgtactgtggagtcagggaggaaaagtaagatttatttgacactcagatttacaggaagaagcatctcaggcactgagggaaggaaaaggagtatgagttatttagggaatggtaagagagcagcatttaaataaaagcatatgctttggtctttagaaagatcttaaatatcatgttaaagagttagtgttgacctaatattgtagcaagatttgttcttcctactttcaaattttaattattctagtttcttttaaagactcgttctctgaaatgttttatattttgtttatttgtttaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattcaaaaaaaactaaaaaaaatgta

SEQ ID NO: 68403 - DNA, 689 bp, Homo sapiens
ctgaagtgggggttttgctattgcaacatgtccaatgaagtggtttcaacagtacaaaaaggattaggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattcaaaaaaaactaaaaaaaatgta

SEQ ID NO: 68404 - DNA, 3153 bp, Homo sapiens
  misc_feature (3129)..(3129): n is a, c, g, or t
  misc_feature (3141)..(3141): n is a, c, g, or t
actcgggtttctgtgtaaacttggccgcggttgccgcaggaaggctagccagagggtaattacacaggtgaggcccggcggggcgggcggagggctcgggaggcgcaggggactggaagagttggctgcgcccaggcaccaggtggaagaatttccataccagccctgcggaggtgcctctgtttccagaggcgtttttgtacgaagggcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgctcaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcagcacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttaatacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggggtggggantaactttaaaangtccccttgggg

SEQ ID NO: 68405 - DNA, 2933 bp, Homo sapiens
  misc_feature (2906)..(2906): n is a, c, g, or t
actcgggtttctgtgtaaacttggccgcggttgccgcaggaaggctagccagagggtaattacacaggtgaggcccggcggggcgggcggagggctcgggaggcgcaggggactggaagagttggctgcgcccaggcaccaggtggaagaatttccataccagccctgcggaggtgcctctgtttccagaggcgtttttgtacgaagggcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgctcaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcagcacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttaatacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattggtaagtaacatctaatatgtcaaatgtaagtctcaaatatttgttatggtttaaattttgttcacaggagatctggttataaaggcccaaggttccattatctataggacacacagtctgatagaataataaacctacagaactagtattaacatccttgcaaataacccactctcctaagaacaaatgctaagtaaatggaggaaataaagatcatgctgtttaaaaaataggaagtggtacggagggnatcctctagaatcagctatcaccatgg

SEQ ID NO: 68406 - DNA, 404 bp, Homo sapiens
ccattatctataggacacacagtctgatagaataataaacctacagaactagtattaacatccttgcaaataacccactctcctaagaacaaatgctaagtaaatggaggaaataaagatcatgctgtttaaaaaataggaagtggtacctttttaaaaaactgttaataggacagtaattgttttcatgacatgttaggtctattatttaggtcttttagctctgttctccccctgctcccccatcttaaaggcctctttttcttctagtcagaagcacccaggccaggcacaatggctcacagcctataattgcaacactttgggaggccaaggcagaaggatcacttgagctcaggagttggagactagcctgggcaacatagtgagactctgtctctaca

SEQ ID NO: 68407 - DNA, 4384 bp, Homo sapiens
actcgggtttctgtgtaaacttggccgcggttgccgcaggaaggctagccagagggtaattacacaggtgaggcccggcggggcgggcggagggctcgggaggcgcaggggactggaagagttggctgcgcccaggcaccaggtggaagaatttccataccagccctgcggaggtgcctctgtttccagaggcgtttttgtacgaagggcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgctcaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcagcacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttaatacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattcaaaaaaaactaaaaaaaatgta

SEQ ID NO: 68408 - DNA, 4479 bp, Homo sapiens
actcgggtttctgtgtaaacttggccgcggttgccgcaggaaggctagccagagggtaattacacaggtgaggcccggcggggcgggcggagggctcgggaggcgcaggggactggaagagttggctgcgcccaggcaccaggtggaagaatttccataccagccctgcggaggtgcctctgtttccagaggcgtttttgtacgaagggcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgctcaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcagcacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttaatacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtggtatgtgttttatagcctacaattgcaataatcattctctcacatacatatagaacttagccctttctcctgctactgctgctgcaacaactttgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattcaaaaaaaactaaaaaaaatgta

SEQ ID NO: 68409 - DNA, 4275 bp, Homo sapiens
actcgggtttctgtgtaaacttggccgcggttgccgcaggaaggctagccagagggtaattacacaggtgaggcccggcggggcgggcggagggctcgggaggcgcaggggactggaagagttggctgcgcccaggcaccaggtggaagaatttccataccagccctgcggaggtgcctctgtttccagaggcgtttttgtacgaagggcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgctcaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcagcacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttaatacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattcaaaaaaaactaaaaaaaatgta

SEQ ID NO: 68410 - DNA, 4422 bp, Homo sapiens
actcgggtttctgtgtaaacttggccgcggttgccgcaggaaggctagccagagggtaattacacaggtgaggcccggcggggcgggcggagggctcgggaggcgcaggggactggaagagttggctgcgcccaggcaccaggtggaagaatttccataccagccctgcggaggtgcctctgtttccagaggcgtttttgtacgaagggcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgctcaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcagcacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttaatacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtggtatgtgttttatagcctacaattgcaataatcattctctcacatacatatagaacttagccctttctcctgctactgctgctgcaacaactttgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagctttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagtaacacactatgcaagcatgtgtactttttatatctctcatgtttagtttttataacaccatatccaggttgctatctcacatagtagtcctttaacatattgtattagcagtgcaatgtggactaagctgcttcactttccctttgcaagttcagatcatcatgcccattcatagccaggattccttatccccaaaacagttctatttttccttaatcactactatagagtctttacattaaattactgtcgtatgctagataattttctcaaattgttaaaagaatatgtactttggaaacaaattagtatttatattgtaaatatattcaaaaaaaactaaaaaaaatgta

SEQ ID NO: 68411 - DNA, 3279 bp, Homo sapiens
actcgggtttctgtgtaaacttggccgcggttgccgcaggaaggctagccagagggtaattacacaggtgaggcccggcggggcgggcggagggctcgggaggcgcaggggactggaagagttggctgcgcccaggcaccaggtggaagaatttccataccagccctgcggaggtgcctctgtttccagaggcgtttttgtacgaagggcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgctcaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcagcacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttaatacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatggcaagtattttttatattgtatgttttcctgccaaatcaaccaacttaatgacaaatttaagtgctttgatgcagtacttgaaaatataaatcatttcctaacagctgaatacaaactaatatgccaaaatattacctcacaacttctttctaagctagtt

SEQ ID NO: 68412 - DNA, 2190 bp, Homo sapiens
tcgggcgggcgggcgggcgggacggcgccccccgcggccgggcctggccgggctgcgctaggctgggctcgggcagggtcgcaggggcgggggtggcaggggagcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggaacgcgctcatgttcaacaacgagctcatggccgacgtgcacttcgtcgtggggcccccgggggcgaccaggacggtgcccgcccacaagtacgtcttggctgtcggcagctccgtcttctatgccatgttctacggagacctggcggaagtcaaatctgaaattcacattccagacgtggagcccgcagcctttctgatcctcttaaagtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataacaaaaaaaagt

SEQ ID NO: 68413 - DNA, 2421 bp, Homo sapiens
tcgggcgggcgggcgggcgggacggcgccccccgcggccgggcctggccgggctgcgctaggctgggctcgggcagggtcgcaggggcgggggtggcaggggagcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggtgagcccgtgccccgcggcccccgcgcccgcgcgcgcccacgcccccagcccgtgcctctacctttgcaggaacgcgctcatgttcaacaacgagctcatggccgacgtgcacttcgtcgtggggcccccgggggcgaccaggacggtgcccgcccacaagtacgtcttggctgtcggcagctccgtcttctatgccatgttctacggagacctggcggaagtcaaatctgaaattcacattccagacgtggagcccgcagcctttctgatcctcttaaagtaagtccactctactggggagggacgggtgggtccgttttaggcggcctccggaggcttctgaagggaagcacacaggagctgatggactcctctcccaggcccagccccgcgatgggtgcttgggagccagccctgacgcgggccctgcctcgcctaggtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataacaaaaaaaagt

SEQ ID NO: 68414 - DNA, 2261 bp, Homo sapiens
tcgggcgggcgggcgggcgggacggcgccccccgcggccgggcctggccgggctgcgctaggctgggctcgggcagggtcgcaggggcgggggtggcaggggagcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggtgagcccgtgccccgcggcccccgcgcccgcgcgcgcccacgcccccagcccgtgcctctacctttgcaggaacgcgctcatgttcaacaacgagctcatggccgacgtgcacttcgtcgtggggcccccgggggcgaccaggacggtgcccgcccacaagtacgtcttggctgtcggcagctccgtcttctatgccatgttctacggagacctggcggaagtcaaatctgaaattcacattccagacgtggagcccgcagcctttctgatcctcttaaagtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataacaaaaaaaagt

SEQ ID NO: 68415 - DNA, 2425 bp, Homo sapiens
tcgggcgggcgggcgggcgggacggcgccccccgcggccgggcctggccgggctgcgctaggctgggctcgggcagggtcgcaggggcgggggtggcaggggagcgggtggcagccccgcgggtcacagcgccgccgccgcccatgctgctgcccctagcctgcctgcacggccgcgtcgctcagtgcctgacctccttgcttttgcttgcagagccgctcccgaggccccggcgcggcgcgagggcgcggggcgcggcgtccacaggcgccgaggctgcccccgccgccccgcccgcgaagatggcggcggaactctacgctcccgccagcgccgcggccgcggacctagccaacagcaacgccggcgccgccgtgggcaggaaggccgggccgcgcagcccgcccagcgcccccgcgccagcgccgccgccgcccgcgcccgcgccgcccacactcggcaacaaccaccaggagagccccggctggcggtgctgccgccccacgctgcgcgagaggaacgcgctcatgttcaacaacgagctcatggccgacgtgcacttcgtcgtggggcccccgggggcgaccaggacggtgcccgcccacaagtacgtcttggctgtcggcagctccgtcttctatgccatgttctacggagacctggcggaagtcaaatctgaaattcacattccagacgtggagcccgcagcctttctgatcctcttaaagtacatgtacagtgatgagatcgatctggaagccgacacggtgctggccactctgtacgctgctaagaagtacatcgtcccagcattggcaaaagcctgtgtcaactttctggagacaagtttggaagccaagaacgcctgcgtcctgctgtcccagagccggctgtttgaggagcccgagctgacgcagcgctgctgggaggtcattgacgcacaggccgagatggccctacggtccgaaggcttctgtgagatagaccggcagacgctggagatcattgtcactcgggaggccctcaacaccaaagaggcggtggtcttcgaggccgtcctgaactgggccgaggcggagtgcaagaggcaggggctgccaatcaccccacgaaacaagaggcatgttctggggcgagccctctatctggtccgaattccaaccatgaccctagaggagtttgccaacggcgctgcccagtcagacatcctgactctggaggagacccacagcatcttcctgtggtacacggccaccaacaagccccgcctggactttcccctgaccaagaggaagggcctcgccccgcagaggtgccaccgattccagtcttctgcctaccgcagcaaccagtggcggtaccgcgggcgctgcgacagcatccagtttgcagtggacagaagggtatttattgcagggctgggcctgtatggctccagctctgggaaggctgagtacagcgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacctcgtgccgaattcggcacgagcccaaaagggcgtgaccgtaaaaacccgcgaaaccacaaaggccaacaagcctgctgctctcgcggcttaatgaccgcgacctcgcccggtggccctgccgggggctcaccggatgcggggacacaaacccggctagcctggggccacgccccctaaccccaggcgaagcgcaagggggctcgcccctggccgcccgtccgcgggctaagccagggggacacctaaaacgcggactacgcgcgctcgtgcc

SEQ ID NO: 68416 - DNA, 600 bp, Homo sapiens
  misc_feature (50)..(50): n is a, c, g, or t
gcactctagagatcgcttaccggatctgggtaggaaaatgcggaaactgngaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataacaaaaaaaagt

SEQ ID NO: 68417 - DNA, 888 bp, Homo sapiens
gacagggtctagctctgttggtctggagtgcagtggtgcagaggttgcagtgagctgagattacaccactgcactccagcctgggtgacagagtgagactccatctcaaaaactgaaaataaaaataaaaatatgtattctcctaactgaaatatttacttaatctggaaaacaatgtaactatttttaaagtggttacatctattcttgctgaagaacaataaacagaattttttgactaagcataaccaaatttcagaacagtctaatcaatgccaagtatccaaggcaaactctaatacccatccattgtgcaaaaccacaagcacgcaagtattaaataagagcaagctgtcctgagcccatacctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaa

SEQ ID NO: 68418 - DNA, 188 bp, Homo sapiens
  misc_feature (13)..(13): n is a, c, g, or t
atatggagtggcnccagatttaacctatttaaaataaaagacaataaatgcacaaaagatataaacaggaacagcaaatatttatattttttccattttgctctttttaaatctatgtttagaactttatatcttgggacttatgtatatatataccttttaaataaaataaattttctaaataaaaa

SEQ ID NO: 68419 - DNA, 3372 bp, Homo sapiens
  misc_feature (3)..(3): n is a, c, g, or t
gcntgcactatagccaagtttgttcaaacagccggctggtaccggtcggaattccgggataaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcgttgctacgatgaagactttggaaatttcctttctcttttaggacagggtcaggatttaggactcatagcctgaaagctcattacatactccttgtaaccatcagtccaaggttcagttcactaaagtgcatgttctaaaacaagagctatcctcattccaaattttaaaatatgtactctggccggttgcagtggctcacgcctgtaatcccagcactttggcaggccgagatgggcggatcttttgaggtcaggagtttgagaccagcctggccaacatggtgaaaccccgtctctactaaaaatacaaaaattagccaggcatggtggcatttgcctgtaatcccagctactcgggaggctgaggcaggagaatcacttgaacctgggaggcagaggttgcagtgagctgagattacaccactgcactccagcctgggtgacagagtgagactccatctcaaaaactgaaaataaaaataaaaatatgtattctcctaactgaaatatttacttaatctggaaacagaattttttgactaagcataaccaaatttcagaacagtctaatcaatgccaagtatccaaggcaaactctaatacccatccattgtgcaaaaccacaagcacgcaagtattaaataagagcaagctgtcctgagcccatacctaatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaa

SEQ ID NO: 68420 - DNA, 3451 bp, Homo sapiens
  misc_feature (3)..(3): n is a, c, g, or t
gcntgcactatagccaagtttgttcaaacagccggctggtaccggtcggaattccgggataaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcgttgctacgatgaagactttggaaatttcctttctcttttaggacagggtcaggatttaggactcatagcctgaaagctcattacatactccttgtaaccatcagtccaaggttcagttcactaaagtgcatgttctaaaacaagagctatcctcattccaaattttaaaatatgtactctggccggttgcagtggctcacgcctgtaatcccagcactttggcaggccgagatgggcggatcttttgaggtcaggagtttgagaccagcctggccaacatggtgaaaccccgtctctactaaaaatacaaaaattagccaggcatggtggcatttgcctgtaatcccagctactcgggaggctgaggcaggagaatcacttgaacctgggaggcagaggttgcagtgagctgagattacaccactgcactccagcctgggtgacagagtgagactccatctcaaaaactgaaaataaaaataaaaatatgtattctcctaactgaaatatttacttaatctggaaaacaatgtaactatttttaaagtggttacatctattcttgctgaagaacaataaacagaattttttgactaagcataaccaaatttcagaacagtctaatcaatgccaagtatccaaggcaaactctaatacccatccattgtgcaaaaccacaagcacgcaagtattaaataagagcaagctgtcctgagcccatacctaatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaaaaaatctaaatattatagaaaggta

SEQ ID NO: 68421 - DNA, 3426 bp, Homo sapiens
  misc_feature (3)..(3): n is a, c, g, or t
gcntgcactatagccaagtttgttcaaacagccggctggtaccggtcggaattccgggataaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcgttgctacgatgaagactttggaaatttcctttctcttttaggacagggtcaggatttaggactcatagcctgaaagctcattacatactccttgtaaccatcagtccaaggttcagttcactaaagtgcatgttctaaaacaagagctatcctcattccaaattttaaaatatgtactctggccggttgcagtggctcacgcctgtaatcccagcactttggcaggccgagatgggcggatcttttgaggtcaggagtttgagaccagcctggccaacatggtgaaaccccgtctctactaaaaatacaaaaattagccaggcatggtggcatttgcctgtaatcccagctactcgggaggctgaggcaggagaatcacttgaacctgggaggcagaggttgcagtgagctgagattacaccactgcactccagcctgggtgacagagtgagactccatctcaaaaactgaaaataaaaataaaaatatgtattctcctaactgaaatatttacttaatctggaaaacaatgtaactatttttaaagtggttacatctattcttgctgaagaacaataaacagaattttttgactaagcataaccaaatttcagaacagtctaatcaatgccaagtatccaaggcaaactctaatacccatccattgtgcaaaaccacaagcacgcaagtattaaataagagcaagctgtcctgagcccatacctaatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaa

SEQ ID NO: 68422 - DNA, 3620 bp, Homo sapiens
aaatctttacgaaaaatgacccacatcaagatgtgctctgcgaagtattccgcatcatgtgataaaagggtccttctcccagatttagaattttatgttaatcttggagattggcccttggagcatcgaaaagtcaatggaacccctagccccatacctatcatttcatggtgtggctctctggattcaagagatgttgtccttccaacgtatgacatcacccactccatgcttgaagccatgcggggtgttacaaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcgttgctacgatgaagactttggaaatttcctttctcttttaggacagggtcaggatttaggactcatagcctgaaagctcattacatactccttgtaaccatcagtccaaggttcagttcactaaagtgcatgttctaaaacaagagctatcctcattccaaattttaaaatatgtactctggccggttgcagtggctcacgcctgtaatcccagcactttggcaggccgagatgggcggatcttttgaggtcaggagtttgagaccagcctggccaacatggtgaaaccccgtctctactaaaaatacaaaaattagccaggcatggtggcatttgcctgtaatcccagctactcgggaggctgaggcaggagaatcacttgaacctgggaggcagaggttgcagtgagctgagattacaccactgcactccagcctgggtgacagagtgagactccatctcaaaaactgaaaataaaaataaaaatatgtattctcctaactgaaatatttacttaatctggaaaacaatgtaactatttttaaagtggttacatctattcttgctgaagaacaataaacagaattttttgactaagcataaccaaatttcagaacagtctaatcaatgccaagtatccaaggcaaactctaatacccatccattgtgcaaaaccacaagcacgcaagtattaaataagagcaagctgtcctgagcccatacctaatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaa

SEQ ID NO: 68423 - DNA, 2978 bp, Homo sapiens
  misc_feature (1)..(1): n is a, c, g, or t
naaaaattagccaggcgtcggtagctgggattacaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcgttgctacgatgaagactttggaaatttcctttctcttttaggacagggtcaggatttaggactcatagcctgaaagctcattacatactccttgtaaccatcagtccaaggttcagttcactaaagtgcatgttctaaaacaagagctatcctcattccaaattttaaaatatgtactctggccggttgcagtggctcacgcctgtaatcccagcactttggcaggccgagatgggcggatcttttgaggtcaggagtttgagaccagcctggccaacatggtgaaaccccgtctctactaaaaatacaaaaattagccaggcatggtggcatttgcctgtaatcccagctactcgggaggctgaggcaggagaatcacttgaacctgggaggcagaggttgcagtgagctgagattacaccactgcactccagcctgggtgacagagtgagactccatctcaaaaactgaaaataaaaataaaaatatgtattctcctaactgaaatatttacttaatctggaaaacaatgtaactatttttaaagtggttacatctattcttgctgaagaacaataaacagaattttttgactaagcataaccaaatttcagaacagtctaatcaatgccaagtatccaaggcaaactctaatacccatccattgtgcaaaaccacaagcacgcaagtattaaataagagcaagctgtcctgagcccatacctaatgaatttgtgtcttaaatattgtacattgtgtttgaggcttgtcaaaactgggattatggcaagaaaggttgcctaactcatacctttctgcctcaaattccaggtgctaaaggctaatggcattttaaacatcttacatttttaaaaatttatattgcctctgccaaacaggcctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaa

SEQ ID NO: 68424 - DNA, 3273 bp, Homo sapiens
  misc_feature (3)..(3): n is a, c, g, or t
gcntgcactatagccaagtttgttcaaacagccggctggtaccggtcggaattccgggataaatgatctcctctctattcagggaaatacagggccttcctggatcaataaaacagagagagctttcttcagaggtagagacagccgagaggagaggctccagttggtacagctgtccaaagaaaatcctcagctactagatgcaggaattacaggatatttctttttccaagagaaagaaaaggagcttggaaaagccaagttgatgggtttctttgatttctttaagtacaagtatcaagtaaatgtggatgggaccgtggctgcttacagatatccatatctcatgctgggcgacagtctggttttaaagcaggactcgccatattatgaacatttctacatggcactagaaccttggaagcattatgttccaattaaaagaaatctgagtgatttattagagaaagttaaatgggctaaggaaaatgatgaagaagccaagaagattgcaaaagaaggacagttgatggctagggacctactacagccacacaggctttactgctactattaccaagtactgcagaaatatgccgagcgccagtccagcaaacccgaagtacgtgatggaatggaacttgttcctcagccagaagatagcacagccatctgccagtgccacaggaaaaagccttcaagagaagaactttgagtcagcccagaatcacactcctgtgtatcccggctacactttaaggaaagattgaatctaagctgtgaaggacagtatagaagactgcaccaagtggactagttctcccggtggctttatatatgtagatggatatagcagtactggttgagtatccctcatctgaaatgcttaggaccaggagtgtttcaggcttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcgttgctacgatgaagactttggaaatttcctttctcttttaggacagggtcaggatttaggactcatagcctgaaagctcattacatactccttgtaaccatcagtccaaggttcagttcactaaagtgcatgttctaaaacaagagctatcctcattccaaattttaaaatatgtactctggccggttgcagtggctcacgcctgtaatcccagcactttggcaggccgagatgggcggatcttttgaggtcaggagtttgagaccagcctggccaacatggtgaaaccccgtctctactaaaaatacaaaaattagccaggcatggtggcatttgcctgtaatcccagctactcgggaggctgaggcaggagaatcacttgaacctgggaggcagaggttgcagtgagctgagattacaccactgcactccagcctgggtgacagagtgagactccatctcaaaaactgaaaataaaaataaaaatatgtattctcctaactgaaatatttacttaatctggaaaacaatgtaactatttttaaagtggttacatctattcttgctgaagaacaataaacagaattttttgactaagcataaccaaatttcagaacagtctaatcaatgccaagtatccaaggcaaactctaatacccatccattgtgcaaaaccacaagcacgcaagtattaaataagagcaagctgtcctgagcccatacctaatagttaaaagcaagttgagacaaaccaggcagattcagtgtgtggaacaggaaggatgtgctttaaaaaaaggtggaatccctcaaaaaattctatagggagacagcagccttaatctacataattcttcatctcgccaattcagccgcagcctttaaagagttagtgttaatggctttctggtttgaaaacaaaaatgcatctatgtggttgaaagtttgggaggagattcaccaatatctgaggagaagatggagtgaagggaattcttactttttgctttatacctttctataatatttagatttttttttactgtaagtatggatcaaattgcaaaataaagaaaaatgccaaccttagaaaagacaataaatgcacaaaagatataaacaggaacagcaaatatttatattttttccattttgctctttttaaatctatgtttagaactttatatcttgggacttatgtatatatataccttttaaataaaataaattttctaaataaaaaaaaatctaaatattatagaaaggta

SEQ ID NO: 68425 - DNA, 673 bp, Homo sapiens
attccagtctgatggagaagatatgatgctagccccagggttcctagtctaatggaggagataggggcctggtttttgtcttggcgatcccagtctgatgggggagatgggagcaaatctatgccctggagactgcagagaaatggagatggatttcatggagtctacatggctcctccctggcaggacacactgggtcagaatcaaataacccatctgcggaggcaagactcacacagggccaccggcagagggatgggatggaagggaggcggtggcagggacaggagggatgtgtgtgcagtgtgatgttgaggtgccagtggaggcactcacagcacctgggggaggacgagggagagagccggctcctgtccatgagggctagggggcaagcgagggcctcctggcccctacccactttaaattgcctgcttctcctgcagcggtgaccacctgtcaggtgcctaccattgtggaagaggtccaggatggtaaggtcatctcctcccgcgagcaggtccgccagaccacccgctgaggactcagctttcccggccggccccccaggaggcagggaggcagcggtcccatctgccccgcggtctccggcctctccaccctcagccccctgcttcagtcccttcgccatgcttccctgcgtgatgacaat

SEQ ID NO: 68426 - DNA, 605 bp, Homo sapiens
tcccagacatttgtaactttggtttttcctgatttttatcctcacttgtacagatatttcttgggaggtacctaaggaagattttcatctccacccagcttccttcccttcttccatgccaggagttggcatgttcacaaaccacagattgtaaactggtacccattcatggagctgcagggagaaagggttgaccagagagccactcagtgcctggcatatccgtagtcctggagaacagagggtcatccttcctcagcgagtgggcttccaagaaatgcatttacaaaaattgttaagctattttgcatcatgctcagatttgccatgatcaaaactaacccttcagtctaaatcgcctgtcaggtggaaattaacaaccagctggagtctcatgcttttcaacattttagtagcagcatctccccatccattctgccttactgctgggctcctaaaaaaataagagtgaggctgggcatggtgactcacatctgtaatcccagctttttgggagtccgaggtgagggaatcatctgaggccaggagtttgagaccagcctgagcaacatagcaaggcctcctcaccccgatctctgaaagag

SEQ ID NO: 68427 - DNA, 726 bp, Homo sapiens
ccattcattcataaagatctggatttgctttaccttgttaatattatctaggggaaaaagtgcaaattgctccatgttcttctctcccttatgtaacatctcctgagggtgtttagttgcatggctgttcagaaaggtattaagggcttaggccaaatcttactttgagtatgttaaaaaaaaaaaaatgctgctggcttttctgaagacaggtgcttgaacttgtcagtttgttttaaataaatacaatagttgaaaatttttctctgttacatcagtaatattgttaaagtaatggatagaaccataacttacacatgaaagtcatatactagatccaatactatttagtttattatcgaaattggaaggattcattgagcagcatagaagtttgtttacatgttactttgagatgctaggtatttgtggaattaaaaagaatcaggctcttttgtactttgtttttaaatctgtgatgcttttcaaatttaattcataataaattgatgcaatttcatacttaggaacatacaaaaggtaatgtaaactctgccacttttttgtgttcaaaattttggtttttatgaagccagatggattgaagagttacataagcatttgaatgctctaatataaggctaatgattttctgttagtgtttgaatatcttcattcctctcaaattcataacagttctatttaactgaattaaataaccatatg

SEQ ID NO: 68428 - DNA, 316 bp, Homo sapiens
tgactgccccctatctaggaaattaaaaatcactggagagattttttttttaaaaagggcaataacagataagtacatagttcttgctttctcagccagccctattaatactttttagaatctcaaatgactgatactgttaactatgtggctaattttaagagggagagtaaaactttttctaaacgactcaagtatcatactctctcagttgttccaagatctcagatttgtgactgtacttattcaaagaatgtcatgcatttgcttttctcttcaagaatgtaacattacaaatgtcttttaaatatgattt

SEQ ID NO: 68429 - DNA, 383 bp, Homo sapiens
tttaatctctgtttagctttttgtgtaaaaggcaggctaggagaggaagtttaaagaattgtctataatagagtttgatttccttctcttttactttctctccattggtaattgattgttaatcataagttctaggcctgtctcttttttttaaaagaaagaaaatgaaatgcattaagctgtgttattgtagtatcatagcagaaatgtagataatgcaccaaagttaagttcagttttggagctcagtgacacctaattcaattatgaatgatctgatagtaacaacatctgtgaaatgtaaaaaaatgttttgttactgtaaaattgcattttataatatatgtacatttatatacaatagcacactttaaaaaatgagt

SEQ ID NO: 68430 - DNA, 343 bp, Homo sapiens
ctacaatagaaggcaaactatgtccctcctttgctcagaaacttttaatatcttcctatttccccatgtaaaagccaatcctcaaccacagtgtagaagggctatccatttctagctacacatctcctcagtcactgcccccagccccagtacttggggactttgcccttgcagttccctgtgccagcaaactcttcctccagatgtccacatgactcacccccctccttcaggggtcttctcaaatgtcactttaccagaggtggcttccctgaccatcctgtataaatagcatcaccctacctcctatctctctctctactggctttttaattatttttat

SEQ ID NO: 68431 - DNA, 3064 bp, Homo sapiens
aggcggaggaggaggcggaggagggggcggggactaagcagggcggtagctggcgccgagcgcggtgggagaggagagggtacccggctggctcggctggcggcctctgcctggatctcggcgccgcagtcctgcgcctctcccgcccctgtctcccgctccgcagccccgggcacggcggaggcagcggagccctgggccatcgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcacctttgtaacatattgtattgacgaatgatcactaagattagctatatctatacagtcattagtttgacaagaaatagaatcctgtcagatgccaaagagtgggatttttatgtttaatgattaaacaccattatttattgacaatttaccctgtggaactgtattatttctaactatgaaataaaggggtgatgtaaacacacattgttgtgtggtgctttaaactaggtccactatcaacaggctacttactgttcaagaattccactgaagcacttattttaaggccctatttttcttaaacaaaacagtgacaacaacaatcaaaccatttacttttgatgctcattggcattttatgataaaagatgtattcatggcaatgatatgtattcaccctattaggaaacacaactggttacctatgagacctgttctgtccgtgtgcctacgttccttaataatagctaaataaaaatttgtagctttttttgt

SEQ ID NO: 68432 - DNA, 2771 bp, Homo sapiens
aggcggaggaggaggcggaggagggggcggggactaagcagggcggtagctggcgccgagcgcggtgggagaggagagggtacccggctggctcggctggcggcctctgcctggatctcggcgccgcagtcctgcgcctctcccgcccctgtctcccgctccgcagccccgggcacggcggaggcagcggagccctgggccatcgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcacctttgtaacatattgtattgacgaatgatcactaagattagctatatctatacagtcattagtttgacaagaaatagaatcctgtcagatgccaaagagtgggatttttatgtttaatgattaaacaccattatttattgacaatttaccctgtggaactgtattatttctaactatgaaataaaggggtgatgtaaacaca

SEQ ID NO: 68433 - DNA, 2377 bp, Homo sapiens
aggcggaggaggaggcggaggagggggcggggactaagcagggcggtagctggcgccgagcgcggtgggagaggagagggtacccggctggctcggctggcggcctctgcctggatctcggcgccgcagtcctgcgcctctcccgcccctgtctcccgctccgcagccccgggcacggcggaggcagcggagccctgggccatcgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcacctttgtaacatattgtattgacgaatgatcactaagattagctatatctatacagtcattagtttgacaagaaatagaatcctgtcagatgccaaagagtgggatttttatgtttaatgattaaacaccattatttattgacaatttaccctgtggaactgtattatttctaactatgaaataaaggggtgatgtaaacaca

SEQ ID NO: 68434 - DNA, 2779 bp, Homo sapiens
aggcggaggaggaggcggaggagggggcggggactaagcagggcggtagctggcgccgagcgcggtgggagaggagagggtacccggctggctcggctggcggcctctgcctggatctcggcgccgcagtcctgcgcctctcccgcccctgtctcccgctccgcagccccgggcacggcggaggcagcggagccctgggccatcgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcacctttgtaacatattgtattgacgaatgatcactaagattagctatatctatacagtcattagtttgacaagaaatagaatcctgtcagatgccaaagagtgggatttttatgtttaatgattaaacaccattatttattgacatcacccctttatttcatagttagaaataatacagttccacagggtaaattgtcaataaagtcgacgc

SEQ ID NO: 68435 - DNA, 1366 bp, Homo sapiens
  misc_feature (6)..(6): n is a, c, g, or t
ccaggnggcattcggtctagaactaccggatcccccgggctgcattaattcggcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcacctttgtaacatattgtattgacgaatgatcactaagattagctatatctatacagtcattagtttgacaagaaatagaatcctgtcagatgccaaagagtgggatttttatgtttaatgattaaacaccattatttattgacaatttaccctgtggaactgtattatttctaactatgaaataaaggggtgatgtaaacaca

SEQ ID NO: 68436 - DNA, 2559 bp, Homo sapiens
  misc_feature (2559)..(2559): n is a, c, g, or t
aggcggaggaggaggcggaggagggggcggggactaagcagggcggtagctggcgccgagcgcggtgggagaggagagggtacccggctggctcggctggcggcctctgcctggatctcggcgccgcagtcctgcgcctctcccgcccctgtctcccgctccgcagccccgggcacggcggaggcagcggagccctgggccatcgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattaaccctggattcccgtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctcaagaggacctgggagaagcttctgctggcagctcgtgcaattgttgccattgaaaaccctgctgatgtcagtgttatatcctccaggaatactggccagagggctgtgctgaagttgctgctgccactggagccactccaattgctggccgcttcactcctggaaccttcactaaccagatccaggcagcttcccgggagcccggcttcttgtggttctgacccagggttggacacagctctcacgaggctctatttacctactacatgggcgggtacccagatttctctgggtttggatgcccccggacaaggggcccacggttagggggn

SEQ ID NO: 68437 - DNA, 1625 bp, Homo sapiens
aggcggaggaggaggcggaggagggggcggggactaagcagggcggtagctggcgccgagcgcggtgggagaggagagggtacccggctggctcggctggcggcctctgcctggatctcggcgccgcagtcctgcgcctctcccgcccctgtctcccgctccgcagccccgggcacggcggaggcagcggagccctgggccatcgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaatta

SEQ ID NO: 68438 - DNA, 2712 bp, Homo sapiens
aggcggaggaggaggcggaggagggggcggggactaagcagggcggtagctggcgccgagcgcggtgggagaggagagggtacccggctggctcggctggcggcctctgcctggatctcggcgccgcagtcctgcgcctctcccgcccctgtctcccgctccgcagccccgggcacggcggaggcagcggagccctgggccatcgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcacctttgtaacatattgtattgacgaatgatcactaagattagctatatctatacagtcattagtttgacaagaaatagaatcctgtcagatgccaaagagtgggatttttatgtttaatgattaaacaccattatttattgaca

SEQ ID NO: 68439 - DNA, 2956 bp, Homo sapiens
cgcgcacgctcgctcgctccctcccttggccgctgttcccgcaccgcggggcagcgggcctggaggcccctttgagaagtagctttccccggccggcggcacctttggctgcgtgcccggccgcgctcagggtgcgactgcccgggtcagatagcacctcagggcgagccccggcggtctgatctcgccgaccctcctcgtcctggttgcaacccgcgtgcgaggccgcccgcgccctccgagtgtctgccggtgcagtgggggtggactggccggctgtggccgtgtgtgcgcgtgtggattggggcccggtccgagccagaagcttaagcggcagatgtcgggcattgccaccctcgccccacctgtcgcgggtggactttggggcagtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaatttgggatacaaagtatttattttacaatgggtgggcgggggaaacttttccagaaagtttccaatatgacgttttcataagttgaaaaaactctccttagtgcttattttctaacttaaaattcacctggaactttaaatgggaaaggattcttttaattgtggattataggcataatactgtttgcatctgaattttctgtaagtgaataatagtttaatagaggaactcatgatttgtactattgaatgattaaactaagtatgaagtgataccattcagcatggcatcaggtcattgcagttttagttctgtgtaacacaagcactcactgaaattccagtttctaggattagtgtaggagcctaacgtgcttctactgttttaatgggttaatcctggattacttaacaatttatgtcaattgcactggtttaatttgttgctaaagaaataatgccctgggtttagtaacaaatacagctcaactattcttgaatatattttgaaaaaaaaatgtatgtaacttaccttttgtaaacgttccatttcttttttccctcatttttgactcttaaaggtgcaatttattactgaattgggatttctggcagcacagaactgctttttattttggggtctgtgagtttcttaggtattagcaatcttgcttataaaataagaacaccttttaattaatgagtgggtcattcctggtgcaattgtgatttttctttagccagaatgaatggcaaactctatttagagcaaagtaagtattagaaaaccctaggaactcttaatcaacgtttattacactttcattaaggcaaactacgtgaaagagccttggggaagttggcccatatcttactaagttgatcagatttctcgttgggctggaaatgtttcgctgttgtatattttaaagtaaattgcacctttgtaacatattgtattgacgaatgatcactaagattagctatatctatacagtcattagtttgacaagaaatagaatcctgtcagatgccaaagagtgggatttttatgtttaatgattaaacaccattatttattgacaatttaccctgtggaactgtattatttctaactatgaaataaaggggtgatgtaaacaca

SEQ ID NO: 68440 - DNA, 281 bp, Homo sapiens
ttgagaggtggttaaaaagagcacaggcttggagtcagacctgggtttaaattctggttttgcttatttattagctgtgtgatcttgcggtccgtgtgatcttgaggtccgtacttaacttctctgttccccctgccccagcccccaacaacctagaaaagtaggaaaaatcatctctaccctgcaaggttgttgtgaggatgacacaaagcaaactcatcagacacacagtgtgtggcatgtagtaggtgctcattaaacacttgatctcctcctttaac

SEQ ID NO: 68441 - DNA, 277 bp, Homo sapiens
cacccacatcttgtcactagcataaggattcatccttgcagggagcatcccctcaagattgccctgaccttgagatcaaagtgggtatctactccccgaggccacaggttcctcaggctgctctgataccccagtctcctgcctccttggacagttctctgctggggatggtcaaaaactcacttattgggccagacgcggtggctcacgcctggaatcccagcactttgggaagctgaggcaggtggatcatttgaggtcaggagttcaagaccag

SEQ ID NO: 68442 - DNA, 367 bp, Homo sapiens
tcagggagaaacctaatcctttaatagaagaataaccatatacaatatttttaaaaggtgtcctaaagaaacctttcttatctactcttggaaagtaaaaatttgttatcaattataagggtgacgttggtattcatctcatttagcctcaatttctgtaacagtcaaagggtagaattttattaattcttcttatttatctatagcccatcttttccagaaagaatttaagggagcgacatagtcgagatgtttgtcccctccacatgtcatgttgcaatgtgatccccagtgctggaggtggggcctggtgggaggtattggggcatgggggcggatccctcatgaatagcctagcagcatcctc

SEQ ID NO: 68443 - DNA, 310 bp, Homo sapiens
gaaataatggccccctttgggaataaaagagatctcaaatcctgttgcagtcagtagcgctggctgtctgcagtacagatggttttcaatgattgtttcagaaattccttatcaacagaaaatgaacgagacggggagttttcagaaaataaatggatttgcagacaacttaacgtcatcatcgaagtcaccaaagaaagcaaagcagcgactggggaagctgaggctgaagtagcaagggcatgccacccaggctgctattccagtcgctgtgaaagcctggtcactgtctttgccacgcagaacacat

SEQ ID NO: 68444 - DNA, 653 bp, Homo sapiens
gggagtggatgaggatcactgtggcacctgggcctgcttatgctctcttcctccttcccattcgctggaacatggatgggcctgggacccagctctgactttgcaagtgaggacaatgctccaggcccaagtggaagtttctcaactactgacatttggggcaggacggttctttgttgtggggggcagtcccgtgcattgtaaaacattcagcagcatccatgtcctccactcactagataccagtatcacagcccaagtcatgacacccaaagtatctccagacgttgccaaacataccctggtgggaaaattcaccctagcagagaaccgctggcctagaggaaggcagagaaacgaggattcctgagttcctgcacggagcagagcagcccggggaccaacctggaatactcagttcagactactgaggaagacaaaataaacttttatgcttttaaaaaaaattatggacagaacaatatagacaaaaacaaaccaaactccattacacagctttgcttctttggttacaagtaggttgaacaatttcacagctttttattcccacccaaaaaaaggtcatacgacatgtgaaagcaaggatcgtggcattctctagaagtgaacaaatgacaagttcctcatcaaat

SEQ ID NO: 68445 - DNA, 607 bp, Homo sapiens
gtgggaggtcgggggcgtccccgcgggttaagcgtgcgagagagcgaggtgcaccagcgggcatggatggcctgtgcagagtccagtcttgtgagggcggcgaactaggcagcgaatcgcgggagtttcctattggcagcagtccgagtcccagacgttaatttgtaacaaaagtagcgatggccaagcccataaagggggcatctcggaaagccgttcgcatgcacggaagagatgaaagccccgtgcgcgctagaaaacggtttcgcaactcacttcgggaagcaaatgcgctgccccccaaaacataaagttggcgaactgtgcctgaccccgctggggttttggaatgcctcgtcctcacaggaaaaaaatccagggaaatcatcttttccttaaaaagcaaaagtgtccaaattatttctgtgactgaagtagtttgtctgcggttggccagtgacatggcaaggccttgtttgtgcatttaaggtaaatcagattctcttctaggagtctggaagagaacttccccaaagggcaccctctttcccttctgacacagaggaaataccacatataaagagctacaaatgtttgaaggagaaaa

SEQ ID NO: 68446 - DNA, 2051 bp, Homo sapiens
  misc_feature (1290)..(1290): n is a, c, g, or t
tgtgtctgcagcatttctgggctggctccaaagcacctctgtgcaggccctgtacagagctatctaccggtttctcctggctttagctctcctgggtgacccagaccagaccttctgatgtcataataaacatcatggagcttataaaattagagcaatgatgcattttttatgcctcaggaattacactgaattgttaatgtcttggaaaatggctgaatgctgcattcgtagctttcctttcccttaagggtgaattattgagcaggaatgctctctccccaggtccccgccctggctcagagatccctgtctgcacccagctgggcactaattgcaaggtccgatccattcccatcagtgttgaggagaggaagagaggtcttgttggagaagagtagccatcgaggaggggacagtggtgctagggcttccttcagcctcccagcccccagcacaggagagggagacagcagagagggccggagggagggagctggtggcttaaaatggagccgtttacaaccccgcacagcaaatggagccattgggaggacacttgaccgagaggagagcattgcttgagccaggggtgccgtctgcaggacagagacaggaggcagtgttgtttccagggcatcgtggaccatggcacaggtgagcaatttaaaaaggtgattggaatcatatgttagaataatgaccttagcagtcaaaggctcctggaatttgtcatttaatttcatattttaggtggactgatctgtaatttagttaatttcacatctccatctaggaaaactggagctctgcacaatattttctgcagacgacaaagtattcacccaaactatttctcatagtaaaatgtgctctttgtccccagagaactgctgaatactacataagatctgtgtaggagccatgctttaacaacaacaaacacctcagacacacaacaaccctttcctccctcgataaagatactgaaaagaatctggtctctggggtgaggagtaggggaagcaggtgcaagcaagtgggtgcagaggagtgggaagatggcattttgtgtaggaaagaatttaacgttgcccaaagagaggtctggcttttgtcctcaccttctgggaggtgaactctaagcccttggaatatcatgcctgattggagtttgtttgcctgggatccttgtgtcacagaatggtctaaccatatgatttagggtagatgctggccacactggataggtttagggtaggggttggctgtgccagaaagaccaacaangtgacttagggtggggtctttgggtcacgtggtatcagctgactctggaggagctggagagggagggcagtcacctgtgtgatggagccacaataaaaactctgaacactggggctatggtgagctgccctggttggcagtactccatgggtactgtcacacatcaatgccaggaaagtcatgcttttcatgattccatggggaagaggacagtggaagctccatgtctggtaccttcctggactatgccctatgcccttcctcccttggctgattttaatctgtatccttttgatgtaataatgtgcaactgtgagtatgagagcttttgatgagttctgcgtccttccagtgaatgatcaaacctgagggtggtctagggtaccccttgcagttggtgcagcaataaaggtggtcttatgtggatggtgctccctttaacttgacaggtggctaactgatatggttggctgtgtccccacccaaatctcatcttgaatttccatgtgttgtgggagggacccagtcgaagataattgaatcatggaggcaagtctttcctgtgttgttctcacgatagtgaatacatctcacgagatctgatggttttaaaaacaggagttgccctgtaagagctctttctccctttgcctgctaccatccatgtaagatgtgacttgctcctccttgccttccaccatgattgtgaaacttccccagccacgtggaactgtaagtccaattaaacccctttcttttgt

SEQ ID NO: 68447 - DNA, 368 bp, Homo sapiens
tacgcatagaagtctcctccagtcgttggcctgacatgacgctgcctgtgcacaggaaatggttccacgagaaagtgtggcaaagaacatttactgagaaacagcaagtacaagagcacaggaagctcaataaagaagagagagatcacatagcactctgggatactggagttcttcccagctagaccagagagtcctcacggagcacattgccaattcagtggagaccccagaacagccgtaatttaaaggtacacttagtatattactagaataaagtcagctgcagacaaccccttgcacagctggaaagcaagtgtccaagcatcaaatcggtttccaatcaatgaagtgcctgtgagaggaaa

SEQ ID NO: 68448 - DNA, 840 bp, Homo sapiens
acattctaactgcaacctttcgaagcctttgctctggcacaacaggtagtaggcgacactgttcgtgttgtcaacatgaccaacaagtgtctcctccaaattgctctcctgttgtgcttctccactacagctctttccatgagctacaacttgcttggattcctacaaagaagcagcaattttcagtgtcagaagctcctgtggcaattgaatgggaggcttgaatactgcctcaaggacaggatgaactttgacatccctgaggagattaagcagctgcagcagttccagaaggaggacgccgcattgaccatctatgagatgctccagaacatctttgctattttcagacaagattcatctagcactggctggaatgagactattgttgagaacctcctggctaatgtctatcatcagataaaccatctgaagacagtcctggaagaaaaactggagaaagaagatttcaccaggggaaaactcatgagcagtctgcacctgaaaagatattatgggaggattctgcattacctgaaggccaaggagtacagtcactgtgcctggaccatagtcagagtggaaatcctaaggaacttttacttcattaacagacttacaggttacctccgaaactgaagatctcctagcctgtgcctctgggactggacaattgcttcaagcattcttcaaccagcagatgctgtttaagtgactgatggctaatgtactgcatatgaaaggacactagaagattttgaaatttttattaaattatgagttatttttatttatttaaattttattttggaaaataaattatttttggtgcaaaagtca

SEQ ID NO: 68449 - DNA, 526 bp, Homo sapiens
atgggttcaagctcctcatacctgggcccatcccctgggtcctgcagtagcttcagagcttccctccttcttctcatatctctgggttgctacccaatgttcctttcatttctcacccacacctgcctactctagttctaataccaacttggtgacttcttgtcctgtgacaggacatgtgcctgtcagtgtccatgtagccctaacctcttttctttttcatggctgggcataaagggagagagctgagggcaataaaggatcaggggagaggctcctcctgctgattctttctaggagagagttgttagactggcagctggcaggtacccaagtcatagaagcaagacataagaggaaaagcctgaataatcaggtttgggagctggaatatattgaaaccttcttgggaggtttcagaatatattctagcttctcctctaagtgtaccaggaagctgggcagatcccagtccctgggcactgaatggggaaactgagacagaagctaggccttctgggaagac

SEQ ID NO: 68450 - DNA, 903 bp, Homo sapiens
ctgatgttggacgaatggcgctcttttctttaacatcatataggtgtagcaaagatgtaaaatgcttgtctttgggatgcaagaaatgaaggggctgttaaatgatgtaagcaaatattgagttgcgtcctttaaaaataaattatatgagaattttatcttaaattattttatctattacatggattcattcagataaaattacaactagttacaaaagatgactagagaattactttccttagagatcattcaaattaggtaaagatgcaataagcttaatgaaatcatgattatgtgactctacaataggagactttactatttctgaaatttttttaagattttatgtgaacactaataatatacagtgttcaattagttgcatgctagtgtttaaatatattattatcatttttattattatcatgtactacaactagcaaacctggaaggtcgtacgtacttaagatatgtcccacatggtgaatagcactcacactggtgaagtccagatgtaagatgaacattatctgaaattagcagcgactaaaagaagcaacacagaatagttcttatgatgataacacagctcccatgtggcatctgtggttagctttctggctcttagatattagtcttaaactctccctaaattgtgggcagactcattcgcatgctactcacaaattcacataattccattcccacaattgcagcatgccacacacgctgcttaaatacattgtcttaatacaacattcacatattctgtcaaacaatatgctatttgctaatgaaaatgagaatgcaaatgttcagaagactaaccattgcctctgcatttaaaaaaataaaacaaaacactcactatagattaggcgcctgaatgcttgtttacca

SEQ ID NO: 68451 - DNA, 3019 bp, Homo sapiens
  misc_feature (2223)..(2223): n is a, c, g, or t
  misc_feature (3013)..(3016): n is a, c, g, or t
  misc_feature (3019)..(3019): n is a, c, g, or t
atttgatgccagttcctggttgagagctcagctatggctattgactggatatctacacagggctgtcctcgtggcatgggagtctcacaatgacaactgagttctcagaaggagagtgcctacagcaggcactccaaaagaggtaggcagaaggtgtaacacttcatatgacctagctttgggaatcgtgcaatgttacttagttctgctttttaccaatcaagtgagtcacaggctgagtccagattcaggggaaaggaaactagactacatccctttatagggagaatgactaagaatttgtagccacctataatccagtatatgctctgaggtctcagttgcatctgtggttagactagagatatctggatccgtattaacacctactgtcaacaaacagagcaaacagtaggcttctaaggagattcataaaatgactaagctgtcgagatgttgtacacatacaaacacagacatacacatatgcgcacacacaagtatcttattgctaatggaatattactaaggatgaagaaaggccacttttttgagtggattttatttctcctttactgaaaactatcagcactttaagaaatatgaaataattttaaatgcattcctatgaactactgctcctttactttagtctcttgtgataactttatgagatatgcttggcctaatatgtttaaagttaaaggactaattgaggtgaaggcgattgtaagtctaaccattataatattaaaacctagcagagttgtaggaatatatttttttaaaataattcagacagcatactgctatacttaaagtcaagatgctaaagaagatattcacaagtcacctggctttatcacacggcttccagagaaggaaatgagtaaaattccaaagagaagtggtttgtagtcttctttaaaaactgttcttatgggccgggcgcggtggctcacgcctgtaatcccagcactttgggaggccgaggcaggctgatcacaaggtcaggaaatcaagaccatcctggctaacacggtgaaaccccgtgtctactaaaaatacaaaaaaaaaaaaaaaaaaaaaaattacccaggcatggtggcaggcgcctgtagtcccagctactcaggaggctgaggcaggagaatgacgtgaacccggggaggcagagcttgcagtgagctgagatcatgccactgcactccagccttggcgacagagcgagactctgtctctaaataaataaataaataaaacaaaatagaaaagttcttatcactagtacaaggagaaatccttggcttgtcctaatattaattcactgtcgtaatcacagcattcttccttgtttcctcagtgaactccttgaggacaaggaatagtgtcttgaaaacctctttaatcctcaaattaccaagtaccgtgcctagtatatgataaacaacaagcaataaagggatcaggtagtaaaagtaacatctgatcttcctggaaaatgggcactgaatgaccaacaagatttctaagcaattctattacacaaaattcttgaagataccacacagcttgctctttttcggtcaaagcaattctaacttaactaacacctgggaattcctgatatggtcataggaccctgtgctagagtctaaggaggaaaaatatgtataaaatgccgtcttatatattttatacacatgtgattttagtggattaatctggttcataaagtgttgtggggatactcaaattattatcacttatagtataaagaaaagatttagaataaatttacttttttcattctttttcaacaaagagaacaaaacgatcaggtacttttcgttttaaaaagggtctgaaaaaaatctatgttataaaagaagttttcatcgtagccattcagttaaagtaaaattttattggaaccaattttgacaggtttgtgaaaaattctgtctgtttcaggtagcagataataagcgaatttatgatttaaaaagcagtggtggccgggcatggtggctcacacctgtaatcccagcactttgaaaggccgaggcaggtggtttgtttgagctcaggagttcgagaccagcctgggtaacatggtgaaaccctgtctctactcaaaataaaaaaattagcttggcatagtggcacacgcctgtaatcccagctacttgggtggctgaggcaggagaatcacttgaaccngggagatggaggctgcagtgaaccaagatcaaaccactgcactccagcctggggtgacagagtgagaccctgtctcaaaaagtaaaataaaataaaataaaaataaagtaaaataaaaagcagtggtaacaagcagtgatcttataactttcattttctctagggcactcccagaccaagagatggattagctgtttgccacactcctttttattgctagtctccacgtcttaacctatgagagactgtataactgagctgtagatgaaataaggtgggccaaagcaatatatgccacaaggaatacccacaagcatgacttacgttagttttcctgctcgactctaggaaataaagcagaacatagactcagctgctccaccagccccagtgtccacctacctggaactcccataggtattaaataggtgaacattaaaaactttcagtttgctgatccattatatttctgagtacacttgttgttcagcctcacctaccccaatgaatatatgatatcagacatattaaaagacatctggattctgtattaaactattttctatccaagttttaaaagagtatctctatgatttcaaaaatatgtttgaatgaatatctttaatatacaattggctatatgctatctgtaattataccataagcctgggaatttttgttatgtaaaagtttaaatgacaaaatcctgacagatttaattaggtttttgtgaatgttaagttgacagctataggcaacaatatttcattaaagagatatttaaataaannnnaan

SEQ ID NO: 68452 - DNA, 2775 bp, Homo sapiens
tttactgcattttgaaagcttaggctgtatttagggtcaaaactgaacagtaagattcctttcctagctatgagcttcctgaatgaatatttaattggagagcctaccagtgagagaataaaggtagagtgatggtcacttgctgagatttgcagagacatcccaaagcatttaggggcagcatttgtagaaaattcctagaaagtgttttattgagcaactatttatagaatgctatttaggtcatttgttgctgcatagcaaatcaccccaaaacatagtgacttgaaacaatttctttgggagaccgaggtgggtggattacttgaggccaggagtttgagaccagcctggccaacatggtgaaacctcgtctctactaaaaatacaaaaattagctaggtgtggtggtgtgtgcctgtagtcccggccactcaggagactgaggcatgagacttgtttcaacttgggggcagaggttgtagtgagctgagatcacgctgctgcactccaacctgagtgacggagtgaaactctgtctcaacaacaacaacaacaacaaaaacaaaaacaaaacacaattttattatcgcgcatggctttttttttttttttttcttgcttggggtctctcgtggttgcagccagatggtagctgcagctggattcatctggaaggattcctgactcacatgtctggcagttgttgctggcattgtttgggactgacagtgaggaccatcagccagaacctacacatggcctccctgtgcggctcagtttcctcagagcatggtgggtgggcgccaagactgagtatctaagagagaggaactggaattctcttaaccctttgacctggaaactgtcaaaaatcacttctgtcatattctgtgggtcaagtctaagagcccaaattaaagagaagggcacatggaccctacctttcaatgggaggagtgtaacagaatttttaggttgtgtttttaaaccatcacaagagccaaccatttgctaggcactttggagaaacaccctctctttctgtcctcatgaagtttatagcctgggagatagatatcaatccaaaatcacaagaataaaagataaattgcaatatggtaagggttctgaaggagatatgatcagagagtctacaatatggggattgtattaatttgccgaggctgccataacaaggtatcacagaccaggtggcttgaacgatggactttgttttctctcagttctggaggctagaagtcccagatcaaggtgttagtaggtttggtttcttctgagaccttgctccttggctgccagactcctgctgttatccctctgtgtcctcacctggtctttctgctggatacatgctcattcttgtcctaacctcctctttttctcaggacaccaattgtattggattaggcgcacccatatgacctcattttgccttaataacctctttaaagggcctatgtaaatacattcacattctgaggtactgaggattaggattttagcagatgaattttggggggacaaaactaagctcatagcagggaattgcctaaagatttttttgtgttttttttgtctgtaggtatttcttgttatggatataaactcaaattttggagttttgaattatctgtttttagagattgtttatctaaaacctttttacatttgaataaaacgtttatgtggttccaaagtaaaatctgaagcctgttcaaagaaatctggcttccaaacttcaacctcatttcctctgaatgtccttctctatttgaccttggtataatacagttcatagtaattgtttcttactagtaattatttcaacccttctagactgcaagcttcatgaaggcagaaacttttattctcttgttcatagcatcatccacaaaaaatctaacactgtacctagaacacacttggtgtttggtgactagttgttgaatggacatgtggcattggagtttaaggtgtagactggaaccagtaggtttgggaattgtcttcattgtcttcatagaggctatgaaaatggatgagacccatctagtgggatgagttacaaaaagaaaaggcaaacagttgaaggtctatatttaggggacagaacaaggacggtaagcagagagaaaaaaggaacagttggagaaatggtaggaaagtgggagaaagtctgtatcaatgggcattgggaaagcatatatttaaaacggactccttagtcaagaagggcatggttgaaaagtgctgaactggacactggaagacattggttcaagttttgcttctaccttgatttgttgtgtgaccttgggcaaattagtctctgaaaatcagtttcttcacgtgtggaatgagaatcactgtatctatctgcattgtctacctcgtagggtatatgagcttcaagagataatagtgttaactcaaatctagaaacttcttagtgctttagaaatgtaaggttaaggctgggcacggtggctcacgcctgtaatcccagcactttgggaggccgaggtgggtggatcacctgaggtcaggagttcgagaccagcctcaatatggagaaaccccatctctactaaaaatacaaaattagccgggcatggtggtgcatgcctgtaatcccagctactcaggaggctgaggcaggagaattgcttgaacctgggaggcggaggttgtggtgagccaaggtcgcgccattgcactccagcctgggcaacaagggcaaaactctgtcac

SEQ ID NO: 68453 - DNA, 454 bp, Homo sapiens
atagcgtttctcttatttcaatttcttactcttctaggaagttttctcagctaagactgtcaaactagtgggctcttttaaatggtgtttgaaagaattttctcatataaatttcccagaaggatatcagtattttggggttagaaaatggcttagaatgtaagtggcaaaacttcaataacagctcccaaatggcagtccatttactcacatttgaggggattaattatcttggaattcaggtgtctttgttttaacagtattgttttcaaaatattttgaaagatgagcattgcttatgatttatacctgtctcttgtctaccccctttgaagtgctgctgatggctgctaagacccctggaaagagtggattttgaaatttcattttggggatgggaggagcggggagtacttttgccacataatactcttttaaagatcgaggaatgtgt

SEQ ID NO: 68454 - DNA, 466 bp, Homo sapiens
cagaacaaatcttttaataatataatgttatcaccatccttgttttacaaacaatgaaaccgaagcttaggtaatataactgactcaacatcatacgtgcagaggtaggtgaattatctccacagctctatgataatgacaggcattatcagtcattagcttcttctgaatttgtatcaactaaagctagcctatcatataataaagcttcgtggagtttgatggcagtagtgcccagtattggtgaagaaaaaaattcatgaggagaatctgaagctggagttccatggagagaaaacaggtttgggtggtccccttggcaactggaaagcatcctgggctattgtgctgctatagaacagtagaaagaatggagataatttagaaaggtgaggcagagaattccaaagacattttccaggaaggtttgaaaaggagaatttctgcagtgaacgatgcattgtat

SEQ ID NO: 68455 - DNA, 686 bp, Homo sapiens
tcccaccaacaatgtgaaagtgttcctatttctccacatcctctccagcacctgttgtttcctgactttttaatgatcaccattctaactggtgtgagaatgtttctttaagactctgcttccatctagaatgtttcttatccaatgataatgataatgatactccagggtaagaaaataagtcttagtttcatgtgagaatttttctttccccatggtgataaatagtagaagacttttcagggcacactgctcattgcattttctgggttttgtaaaaacttgggatataagaaaaataatgaaactaaacaagcagatttttttctaatcccaactttttaaagatatggtccaccttattatatgatcattagtgaagtgctagccttctcttagggagaaaattatgttcaatagtaggatatttccacatgcaaactagtagagttggttagtcagtttctaataaatatcaattgatatctgtttaaaatgacagcctccttttgttcccaaagctttatcttctcaaatatccatttttttgtgtgtgtatgtacttaacattttagttggtttgaaaagttttgaaattctaccagaaaatcaaactcacaaaatgcagaattataagactctgtattgatctttgggcagaacagactcatatgttcaataccaga

SEQ ID NO: 68456 - DNA, 3415 bp, Homo sapiens
  misc_feature (126)..(126): n is a, c, g, or t
  misc_feature (357)..(357): n is a, c, g, or t
  misc_feature (419)..(419): n is a, c, g, or t
  misc_feature (1551)..(1551): n is a, c, g, or t
  misc_feature (1563)..(1563): n is a, c, g, or t
  misc_feature (1581)..(1581): n is a, c, g, or t
  misc_feature (1586)..(1586): n is a, c, g, or t
  misc_feature (1717)..(1717): n is a, c, g, or t
  misc_feature (1756)..(1756): n is a, c, g, or t
  misc_feature (1766)..(1766): n is a, c, g, or t
  misc_feature (1807)..(1807): n is a, c, g, or t
  misc_feature (1823)..(1823): n is a, c, g, or t
  misc_feature (1833)..(1833): n is a, c, g, or t
  misc_feature (1848)..(1848): n is a, c, g, or t
  misc_feature (1859)..(1859): n is a, c, g, or t
  misc_feature (1998)..(1998): n is a, c, g, or t
  misc_feature (2000)..(2000): n is a, c, g, or t
  misc_feature (2060)..(2062): n is a, c, g, or t
  misc_feature (2091)..(2091): n is a, c, g, or t
  misc_feature (2098)..(2099): n is a, c, g, or t
  misc_feature (2125)..(2125): n is a, c, g, or t
  misc_feature (2127)..(2127): n is a, c, g, or t
  misc_feature (2137)..(2137): n is a, c, g, or t
  misc_feature (2139)..(2139): n is a, c, g, or t
  misc_feature (2159)..(2159): n is a, c, g, or t
  misc_feature (2219)..(2219): n is a, c, g, or t
  misc_feature (2225)..(2225): n is a, c, g, or t
  misc_feature (2374)..(2374): n is a, c, g, or t
  misc_feature (2711)..(2711): n is a, c, g, or t
  misc_feature (2834)..(2834): n is a, c, g, or t
  misc_feature (3147)..(3147): n is a, c, g, or t
  misc_feature (3166)..(3166): n is a, c, g, or t
  misc_feature (3170)..(3171): n is a, c, g, or t
  misc_feature (3221)..(3221): n is a, c, g, or t
  misc_feature (3263)..(3263): n is a, c, g, or t
  misc_feature (3269)..(3269): n is a, c, g, or t
  misc_feature (3314)..(3314): n is a, c, g, or t
  misc_feature (3321)..(3321): n is a, c, g, or t
  misc_feature (3337)..(3337): n is a, c, g, or t
  misc_feature (3346)..(3346): n is a, c, g, or t
  misc_feature (3369)..(3369): n is a, c, g, or t
  misc_feature (3415)..(3415): n is a, c, g, or t
ggaagtagctctcagcagatgggggagccagaagggagatggttttcccctggagttggggcactccacggccagggctctcctcccactgcccccaccaaactccgcctcatcccactcccaccnggacagtgccggcgtgtgtcctgtcggtgtgctcttcagctgccatgctcccctcaacatcctctcgccatccagatgcttgtgccttctttcattgatgtgctcctctctcgcttcaacggcctgtgtgttcctacgctgatatgctgcatttgacatccccctgcctctatcttcttctgctgatccgctcctctacacgtccagtcgtttcggtctttgccttgctanagtctcaggtttttatagtcacaggatggggccgtggtgggccaggatggtcttgggaaatncaacatttgggcgtgcaggcaggagtgccaggtcctcatctaggtcggtgggggtggagccctagccagggaccacacccttcctctacccagcactcccgtatcatttaaagggaccatggtcttgccttcccagcactcctgtatctccggcatccttaaagatactgtatttgagctgagacctgaaggatgaaattggccagcaatgtgagaatcagggaggtgaacgttccaggcaggaagaagagcaagccaaaaacgctgtagcaggcatagattttgagattgtgttaatatttgagttgggtttctaaggtatgaatagaatttagacacctaagtaaaagccagatgagattgccactgcttttactataataataataattattattattattcccacaaaacagcttccttttgttggtcatttcagagtgactcaaatgttttacccctctttgtacaattcttagtgttctctatatttcctttagggtatctagcttctgacaacattgctaattccttagaaaacacagagggaaaaggaggatgcccctgagacttgaagagaggataacttttaaaaaatcacgtcatggaacacatcaagcatctaacatatgctcccttgttattttaaaaatgcaacaatagttgtttttcataagtttgataattacaatttaaggttatgatccaatttcaaaataaatcagttttgttttctacacctcttttccatttggaaatcttcccatgcttatggaacattctaacctctgatacagtaatatcaactgaccaccaaatcttaaaacaaatttcaaaaccttataacaaatttcaaaaccttataacaaatttcaaaatattagaaaagcctgaagcactgaaatatctctgaaaaacctgaaagatttggaaatgatactggaataacttgagcctgctggccgtttgcattcagttccagacagttttagtttgcttctgaaaaataactgatataagtttaaaagggcaaattggtgagaaattgtgaaatatttggtaagctgggatggaatgacaaaatacaaaattgaaaaccgtctgtacagaaagtaaaacacctttgacaaangaaacacagtangagaatgtgatgaaattnggtanaaagaaataattataggccaggctcatgccacccacccaccactcaggtgggtggatcacctgagatcaggagttcgagaccagactgaccaacatggcaaaaccctgtctcttttgcattactaaaaatncaaaaaatttgctgggtgtggtgacacgcacctgtagtnccagctactngggaggctgaggcaggagaatcatttggatccagaggcggnggttgcagtgagccangatcttgccnctgtactctagcctnggtgacagacngagactctgtctcaaaaaaaaaaaaaaaaagattacagatcaaaattacttaacacaacataagttatcaaaaaagagagtatcttgtatgtgtgtgtgtgtgtgtgtgtgtgtgtgtgtgtgtgtgtatatatatatntnttttttttttttttttgagacagggtctccgtctgtttccctgtctggagtgtagtggcnnnatcgtggctcactgtagcctcatctcccnggctcanntcatcctcctgcctcagcctccccantngctgggactntnggcacttaccgccgtgcccngctaatttttgtattttcatagagacgaggttttgccatgttgcccaggcgatccacctnacctanggtgatccacccaccttccagagtgctggaattactggcatgagccaccacatctggcctataatcacttctttttatctaatttcatcacattctcttattacatatcttttgtcaaactcctgggctcaagggatctacctgcttcngcccctcaaagtgctgggattacaggcatgagccaccacacctgactatagaatcttttcttacctgttctaaactagtgcttaattatcttatatacatgtactgttttttgtcttataggaggaagagtttttgccattttaaatttctgtttatttttattctttttcctttacacttgtcttcagttcaattcaccaattctccttaagttagttgcacaaaacaatatatgcctcgagcaaggtgccaaagtatacacgtatattcattttgtgtcttttaattctaaggtcgcaagcccagatgagactggtattgcttttgtcatttatncaacatgatttcctttggcaattcagttgtttcagagtaaactacatttttcatcagtgcctattagactgtaaatgtattatttcagcaaatggtaaacctcctgtaactgtgaataaaagnatcacagtagaaacctctaagttagcaaagagggtagatactaaagggttttaaaatgtatctattttttagaaacttgcttaagtatataacttccatcaaccatatggaatgcccttaatgtgtaaggcatttcacacaatacaaaggtgaaaacgacatccatagatgttatgaaacagacgtttctaggtgagaggctcataatctgaaaaacagaaaatatgtttaaacaagttaagtgtattgtgaaaagtgctataagatacttgtttttaaaatgttgtgggctgggagtggtggccaactcctntaatccccacgcttgggangccnnggtgggaggatcacttgagccctgagttcaagaccagctgggacaacatngggagaccaccatatctgcaaaaaaaaataacaaatcagccnagtgcngtggcacatgcctatagttccagttccagctactgaggaggctgnggcaganggattgcttggacccnggagtttgnggctatagtgagccatgatcgcnccattgcactctagactgcaggacggagagagaccctatcttaaan

SEQ ID NO: 68457 - DNA, 3558 bp, Homo sapiens
  misc_feature (574)..(574): n is a, c, g, or t
  misc_feature (790)..(790): n is a, c, g, or t
  misc_feature (1447)..(1447): n is a, c, g, or t
  misc_feature (1783)..(1783): n is a, c, g, or t
ggaaattagaatctatccttaaaataacaaaacccttacaacttgacatttttaacttgtctattatgctttatagtgccttagattttactaaaagtcacctatcgaataattaattaatttattcatccagtaaaccttcatgctactagatggagggatggcttttaaatcccaggaggaataagttcagactctgtgctcaaggtctcgtagtctagagggaaggccactatacgaaaaaataattataatgtactataatgtaagtactgagtttagctatatatgaagtgctttcagagtttgaaaggaaaaggaagtacctctacctggggagtaatatttttctatagttcagtagggacaaaacttatagcaaattgctacttttattgctgtatattatatggtcatttattgtcatatatgtttgatgctgttctctgtgtaactattgtgaaaaagatgcattcttcaatcccaggggaaatattcagagactagtgtttggtttgctgataaacaagccattgctggagcatattcctatttgcaactctacctcttagcntcatggattatttgacatttatgtttatggttctgtgccattatactatcatgcagcatttcacttaagtcaatgaaggatataagtaatttttctagtttattaaaaatagatttcaacatatatccactgtgtacctacatgccttttaaacctctgatctaaagtctcaccagtgaaagctgaataactagaatggagaaaagagtaattatnagtctctctgtgtctcagttaccccctctgtaaaatgggagaggttgtactatctaccagacaggctgctttgaggattaaatgaattatttatataaagtgtgtttatagcagatgctatataagtgttagctgacgctattgttgttgttattaaagatagtattataaatggtgtgtcattgatttcagaaggacagctggaaactatactgttgattgaattttcttatgtgtcttttataactttaatttttatgggctttgcttttcatttttcccccaagaatcagatatctgccagagtagacctttgcatttgcagcctgacattgtgcattattctaatggaatagcttaggataggttgtaaattcttagatcaaatcttcatgttctgacactagcatacacataagcacatgcacacacacacctctttaaggtttaggtaaaagatcttgaccttccccacctggcttcagtcaatccaaagatgaacagaatgaagaaataactccttaaagacaaagaatctttcaccacttaaaacttaccttttaatattctttactagattgtcttccttttttgatctaggttaaatttatattcaaaaccttggtccaagctcttattcaaatattttagttcatnccactcttctcatccctaaactctctaatttgattggatattctatagtgcagttttccaatgcatgctgaatttctccccatctacattcctaccttcttgagggttgagaccatgcctttccctttggtattccccacaggacatgatatagtggctggttttataaattattgttgttttacacacttcacagactaatactctttgaggagcttccctgctaattccccaacccactaaatgaaggaaatctatttgaaggaaccttcatattgcacttattataatgacatagtaacaatcatttgcagcacttttgcatttactcagatntcatctcttcctggaagcctttcttgaatatctgatttcctctgaattgccttattctctatttcccaaagtaccctgtgaataccattatcttagcattttccatattatatcgacattatctataatatttattgtgtctgtctcatccattctagaaataggatctttgtttactcattttttgtatctccagcacccagccctgtccctagtgctcaattaatgcttgttaaaactgaatgactgtatcttgccagctccatctccttcagtggaaggaggagaaaattttataactgtatttaggtacaagaaatcacagaagaactaaaaaaaaaaacctagattttttattctccttgtcttcaataaacaccagtttcctcactgacataggtatccaaaataaaaacaattaaaaatgaaacacagaaccccacaacttctaacagtgatcagttaaaattgtaaggttttactgaaatgtttagagatgaaataacttgatttctggggaagtggaagtggaggggtaaaactggtcatgagttgataatagatgaaactgagtgatggttcctgagagtgagtggggttaatttatactattctacttttgtatatgtttgaagttttccttaataaggagtttttaaaataaaactttcagattttagatgttagtataagatttttttttcagagtatatcatctctcaattttggtcttgtagctgaatgggtatttcttacttcaaatgaaaagtaaaaagccaacttaaatttgaaattctttggcattggaatggctgagttagtttcttattttgcccttagccattttttgaaattattttttaaatttaagaaaaactacttacatgtgacaaattacattgtttggtggtatttgttatgtgtcttgcaattagaaggaagctatcaaatgtggttttgttatgtgatgtttaggccactggaccacagtcagaagatgtgatggattatactctattcatgttcttgcccagtccccaagagcaatcagagtagctagaccatatcaagaccagagtaatgtgctaagagacattcctatttgacataccaccaatcacattgctttttgagtttatttttcttcaacagtaaggatgagttggtatctagctaaccatcttgatccgttataccttttataccatcagtcagcatttatgagactaccaggtgtgcttaaggcacaattgtttgttttagaatataatttttttatttatgttaaactagcacattgaacccacagctttgatttcatagaagcagagtatactttcctccacaaacttagacatgtttcttgggttctttctctctaagcagtgattctcccagccttcacatctacttactcggatgctccattgactgctcaaagcctgttaacttatgaactcaaaagcataatatgggattccaagtttggatgggcattgctggccttccttttaagatgtaacgaagggaatcttactgtcatcttcagggttttctgtttgtttgccttacgccctacggtattcttcaaaggctagtcccttgacagcataataaacctgagaaggtacaaagaaaactatcagttaaataagcatactgacaatctattgagcaaagaaggaacagcagtacatctttgtttccctatttaatttaaggcttctactagttgttcccctttgtattagaaatcctaaatatatatcctctat

SEQ ID NO: 68458 - DNA, 160 bp, Homo sapiens
gtggtgggactcgaaaagaacaaaggagctctttgtgcatcaggttctcaaaataaaggaatgaagaagccccaatgcatattttaatattttagttggcaatgcaaacgcaacagcattcctaaagagtggccatgtttcttgaaagagatagccaggc

SEQ ID NO: 68459 - DNA, 702 bp, Homo sapiens
tcaaatgtggcagaactgggattagacttgggagactggctgtcttttcactgatggtggagtcagggcccacccaagcacgaggagcaggctgtgtggaggtgtcgtctgacctctaacccaggtggcatggggttgcgcccagcaggatgtagtggagtaaagggaagagggtgctggccgggtgcttagaggtcatctttcaaggaggcattaaatatcaattataaattattaagtcagataaatatgcctgaccttttcacagttgaaaaaatacattttttcccctctatcaaatgccaagtttttagtggaaatgctaatggcagtgggaaaggttgcctcactttcagagagactctcgctgtctgcacccttttaataattgctcttcctggcaaggctgccacttccctgcctccccagctggcagtggggcaacccaggcctgtttccagctacctgcaaagccagacctagacctgccgtagctgttgtcccatgcctaattctagttacaggaagccatccctgtaccctgggtccattcacaggaatgggttccagaggaggctgatagaagggtttgaaatgactggctggatcccttcctgctcagacacagtggtagctggagagcaggcagagatggtagaattgcaggtttgaccacctgtcgtgaccccagatatacatctc

SEQ ID NO: 68460 - DNA, 400 bp, Homo sapiens
tccctccccttcctctccctcttcttttccctctccaggagagtctatgaaaatgattcctttaaattcctattccttctgccaagagttaatacatatcacaccttctctgatgcacatatgttattgattaggtacaatgaaagaattgccatcattttgtccatagctacttgtgaaaggaaaaaatatattattatttacttgcttatagttgtcttggcaatatgaaggagcttcagaaataactgacttatgctaatccaatgtgtcaacaacctgctgaaactacctaaaaatagagcagttttatcatcattttgactcaaattattggaagagccactaccatactcttttcacaaatatggtttttacagaggccaatacagtactagcc

SEQ ID NO: 68461 - DNA, 463 bp, Homo sapiens
caatcctttccagttaccaccccaccccctaccccagccaagacctcaggttgtttccttaaatacgtgttctcatcattactcaattgaatacttgagggggacccttagaattctctctctgtgtagctatgacctttctagtaccatgtcctttgaatttcagctaccttgtgctccttagattcccaaccttgtatatcttcaacacaaagagatcactggctctgcctcggttcctgctccctacatcacagtctggaaaaaactttctttaggcagtaatctggggcactcatggggcttatctcatttgttccccatctcttatgtatcactgttctttgttacctgatgtgcaaagtcataggagatgtgcaatgtttaatgtcaatgtttcatatatatatgcatattttggttttttagttgtgtcacacaggaagataaatctggtctctgt

SEQ ID NO: 68462 - DNA, 455 bp, Homo sapiens
catttgtaattgactgcagatcttcatgccttcaagtcattttctcatgggcacaccaaaatgaaagggcaggtggaaagtatctaaaagcttcaattttgcctgtgtaaacttcaacctctatgacttacattttaaagacccaacagcacaagggatgcaacaaattagaatttaaatgtaattcgtggttgaaatgccacatgaatatgctctggctcccaaatgtcagttgctgaaccacaaaccgattcttaatgatcccttggaagctgtcactaatttttgtgaaccacaatgatggcttctaaaggaggactacaaacccctggagaccaataactggggataacttggaaagcttttggctctctaaaacacccaaggataagaaaatgcttcctaggaagggatttaaagtgaaaaagtagaaatatactgagtgcttgagagat

SEQ ID NO: 68463 - DNA, 1215 bp, Homo sapiens
ctccctcttgctcttcccacccctaaactatgtagcctcaaagatcttacctggctgactgctgggctttcaagatagtttctggaagaagtctctaaatctaagccttcaactctcatctctgttctgaatttcagacctggaattctaactgtccacaatacatggctcctcaatatatcttcctgaaattacaaatgaccatacggtacaggtgttactatattacctgtaagaccacactcggtgtcatctcctgcaaactagtcctctcctgactcctctgtttctgtgagtgattctgcgatggcttgaggtcatccgtttgctttgaaagatcacacaccaggatacatacagagatgtgacccggatggatggacctttgcctcacaatcagggtagaagcctctggttttcttatttctttgtcctcctctgtggtgtgacacaggttcaggaggaggtacccagacacagaagagatgctttccctgtgcaggcttgctgacagtcttgcccaccactcctggcctcctccctctacatgtccacattcgctgctctgaccctgagttggacccagctaggaattgtgacttcagttactagtatttcctctgagcctctagtcatggtcatgggctaatctgtatatgaaaacccacttgaaagaaatcccagtgctgaagaaagaattgaaacatacagatcgtttctttgctcaagggagtgtggatttcagtgctctcactgagcagaggctgagggtgaccaccttggatcttcctgcaggacacagcccagagaaactgagcctgaatttgctgccatgttttgaggacattatccacgctagtctctttcatctgggccgaggtgggtaattttccttagagtcaagtactagaaaaagttttgcttcttctaagagctggtacattgccctcttgtgaatgagagccatgtatgtgaccacaacaccctttcagttgaccactaagagactgaaggccaattccggatcaactttacagccgcctacggcctgctataccacccatggcatagtttctgtggtctgatgctttattttttattgcattttactaatttatggcatgcatatcatatgagcagtctcaaatcctccccagaacaaggtgaggaatatattaatatttaaaataaaataaacaaaatgtcaaaaaaaat

SEQ ID NO: 68464 - DNA, 406 bp, Homo sapiens
agctcccggcctgcccctgtcgccacgtggacagtcaggccccaaacaccggtgtccccgtagcccagcccgccaaaagctgggatccaaaccagctaaatgcgcacccgctggagcctgtgctgcggggcctgaagacagcagagggcgcgctgcgtccgccgcccggaggaaaaggttcatgacagcgtcagattctctgcagcaggagtacaggttgcagccactctcccgccgaacattgaatacgtctttccaccatcttgtctttgctgtggctctgggaaaatcagcagagtcagccatcactctccaaggggagctgtcagttctatctgccagcttttgagtgttcagtttgatttttacttattcaacctggaatttgaatgtctttgatgtgtgc

SEQ ID NO: 68465 - DNA, 253 bp, Homo sapiens
ctgccttggagcctgatgaccacagttcatgacagcgtcagattctctgcagcaggagtacaggttgcagccactctcccgccgaacattgaatacgtctttccaccatcttgtctttgctgtggctctgggaaaatcagcagagtcagccatcactctccaaggggagctgtcagttctatctgccagcttttgagtgttcagtttgatttttacttattcaacctggaatttgaatgtctttgatgtgtgc

SEQ ID NO: 68466 - DNA, 2860 bp, Homo sapiens
ttttcggctgcttggtaacgggctgccagaagagagaggcagagagcagggcagcggcttcttgacgtcagggccaagcgaggggatcgcgccagcaaccccagctctccccagagaggggccggccgacgctggagcggagcctgacgccaggcgcccgcggagcgtgagtagggggcgcgggagccggtcagctggggcgcagcatgccctctgctcccgcgccatggagatcgccctggtgcccctggagaacggcggtgccatgaccgtcagaggaggcgatgaggcccgggcaggctgcggccaggccacagggggagagctccagtgtcccccgacggctgggctcagcgatgggcccaaggagccggcgccaaaggggcgcggcgcgcagagagacgcggactcgggagtgcggcccttgcctccgctgccggacccgggagtgcggcccttgcctccgctgccagaggagctgccacggcctcgacggccgcctcccgaggacgaggaggaagaaggcgatcccggcctgggcacggtggaggaccaggctctgggcacggcgtccctgcaccaccagcgcgtccacatcaacatctccgggctgcgctttgagacgcagctgggcaccctggcgcagttccccaacacactcctgggggaccccgccaagcgcctgcgctacttcgaccccctgaggaacgagtacttcttcgaccgcaaccggcccagcttcgacggtatcctctactactaccagtccgggggccgcctgcggaggccggtcaacgtctccctggacgtgttcgcggacgagatacgcttctaccagctgggggacgaggccatggagcgcttccgcgaggatgagggcttcattaaagaagaggagaagcccctgccccgcaacgagttccagcgccaggtgtggcttatcttcgagtatccggagagctctgggtccgcgcgggccatcgccatcgtctcggtcttggttatcctcatctccatcatcaccttctgcttggagaccctgcctgagttcagggatgaacgtgagctgctccgccaccctccggcgccccaccagcctcccgcgcccgcccctggggccaacggcagcggggtcatggccccgccctctggccctacggtggcaccgctcctgcccaggaccctggccgaccccttcttcatcgtggagaccacgtgcgtcatctggttcaccttcgagctgctcgtgcgcttcttcgcctgccccagcaaggcagggttctcccggaacatcatgaacatcatcgatgtggtggccatcttcccctacttcatcaccctgggcaccgaactggcagagcagcagccagggggcggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacaaccagggaacccatttctctagcatccctgacgccttctggtgggcagtggtcaccatgaccactgtgggctacggggacatgaggcccatcactgttgggggcaagatcgtgggctcgctgtgtgccatcgccggggtcctcaccattgccctgcctgtgcccgtcatcgtctccaacttcaactacttctaccaccgggaaacggatcacgaggagccggcagtccttaaggaagagcagggcactcagagccaggggccggggctggacagaggagtccagcggaaggtcagcgggagcaggggatccttctgcaaggctggggggaccctggagaatgcagacagtgcccgaaggggcagctgccccctagagaagtgtaacgtcaaggccaagagcaacgtggacttgcggaggtccctttatgccctctgcctggacaccagccgggaaacagatttgtgaaaggagattcaggcagactggtggcagtggagtagggaatgggaggcttgctgaacatggatatctacattataccgcagagtatttgaagtcacactgtaacctcagtctacccctctcctttcactcctttcctccctccctcgatccccccattttctctattctttccatgacacccaagggtcgcctatttttaaaaagtaccacattccatgacgcaggagctgtggaaatggtgagcgctgtgagatggatgtatttgtagccagtctcctatacccagcagagggataacccaaacaaaaatgactctaaatagcccagatcccaagagattatgtaactcctccatccatgtgttccaaatttgctttacatatgattgtatttgtgtataggggaaaatattatttttatgcctggtaagtggctttttgtactgtagttcagatagagatattttgggtatattttcaagatacatgttgtatttatggaagaaagagttgtcctgatgtttttctgtgttacttatattagagtcagagatcttggtatgggctgttctgtttcctgtgtctccaagcctctgtcttttctgggatgtggtattggtgctttgtgtctagggcagagtatgttcttgaagaaaggcaaatctgactttttctgtgcgccttaaacaattcttgtaactttcttcaaaaagcattttaatgatattggaggaatacttctgataatttattgtctttatttttatcccaggaaataaaaggttaccttgtt

SEQ ID NO: 68467 - DNA, 201 bp, Homo sapiens
  misc_feature (16)..(16): n is a, c, g, or t
  misc_feature (22)..(22): n is a, c, g, or t
  misc_feature (31)..(31): n is a, c, g, or t
  misc_feature (50)..(50): n is a, c, g, or t
  misc_feature (70)..(70): n is a, c, g, or t
  misc_feature (73)..(73): n is a, c, g, or t
  misc_feature (76)..(76): n is a, c, g, or t
  misc_feature (80)..(80): n is a, c, g, or t
  misc_feature (96)..(96): n is a, c, g, or t
tttaggcatcccttancctttntgtccctcncaagatgctttcgaacagnaactgctttcttaattaaantgntanagantcttcaggaagatcanaattcttgtaactttcttcaaaaagcattttaatgatattggaggaatacttctgataatttattgtctttatttttatcccaggaaataaaaggttaccttgtt

SEQ ID NO: 68468 - DNA, 3036 bp, Homo sapiens
  misc_feature (2984)..(2984): n is a, c, g, or t
  misc_feature (3015)..(3015): n is a, c, g, or t
ttttcggctgcttggtaacgggctgccagaagagagaggcagagagcagggcagcggcttcttgacgtcagggccaagcgaggggatcgcgccagcaaccccagctctccccagagaggggccggccgacgctggagcggagcctgacgccaggcgcccgcggagcgtgagtagggggcgcgggagccggtcagctggggcgcagcatgccctctgctcccgcgccatggagatcgccctggtgcccctggagaacggcggtgccatgaccgtcagaggaggcgatgaggcccgggcaggctgcggccaggccacagggggagagctccagtgtcccccgacggctgggctcagcgatgggcccaaggagccggcgccaaaggggcgcggcgcgcagagagacgcggactcgggagtgcggcccttgcctccgctgccggacccgggagtgcggcccttgcctccgctgccagaggagctgccacggcctcgacggccgcctcccgaggacgaggaggaagaaggcgatcccggcctgggcacggtggaggaccaggctctgggcacggcgtccctgcaccaccagcgcgtccacatcaacatctccgggctgcgctttgagacgcagctgggcaccctggcgcagttccccaacacactcctgggggaccccgccaagcgcctgcgctacttcgaccccctgaggaacgagtacttcttcgaccgcaaccggcccagcttcgacggtatcctctactactaccagtccgggggccgcctgcggaggccggtcaacgtctccctggacgtgttcgcggacgagatacgcttctaccagctgggggacgaggccatggagcgcttccgcgaggatgagggcttcattaaagaagaggagaagcccctgccccgcaacgagttccagcgccaggtgtggcttatcttcgagtatccggagagctctgggtccgcgcgggccatcgccatcgtctcggtcttggttatcctcatctccatcatcaccttctgcttggagaccctgcctgagttcagggatgaacgtgagctgctccgccaccctccggcgccccaccagcctcccgcgcccgcccctggggccaacggcagcggggtcatggccccgccctctggccctacggtggcaccgctcctgcccaggaccctggccgaccccttcttcatcgtggagaccacgtgcgtcatctggttcaccttcgagctgctcgtgcgcttcttcgcctgccccagcaaggcagggttctcccggaacatcatgaacatcatcgatgtggtggccatcttcccctacttcatcaccctgggcaccgaactggcagagcagcagccagggggcggaggaggcggccagaatgggcagcaggccatgtccctggccatcctccgagtcatccgcctggtccgggtgttccgcatcttcaagctctcccgccactccaaggggctgcagatcctgggcaagaccttgcaggcctccatgagggagctggggctgctcatcttcttcctcttcatcggggtcatcctcttctccagtgccgtctacttcgcagaggctgacaaccagggaacccatttctctagcatccctgacgccttctggtgggcagtggtcaccatgaccactgtgggctacggggacatgaggcccatcactgttgggggcaagatcgtgggctcgctgtgtgccatcgccggggtcctcaccattgccctgcctgtgcccgtcatcgtctccaacttcaactacttctaccaccgggaaacggatcacgaggagccggcagtccttaaggaagagcagggcactcagagccaggggccggggctggacagaggagtccagcggaaggtcagcgggagcaggggatccttctgcaaggctggggggaccctggagaatgcagacagtgcccgaaggggcagctgccccctagagaagtgtaacgtcaaggccaagagcaacgtggacttgcggaggtccctttatgccctctgcctggacaccagccgggaaacagatttgtgaaaggagattcaggcagactggtggcagtggagtagggaatgggaggcttgctgaacatggatatctacattataccgcagagtatttgaagtcacactgtaacctcagtctacccctctcctttcactcctttcctccctccctcgatccccccattttctctattctttccatgacacccaagggtcgcctatttttaaaaagtaccacattccatgacgcaggagctgtggaaatggtgagcgctgtgagatggatgtatttgtagccagtctcctatacccagcagagggataacccaaacaaaaatgactctaaatagcccagatcccaagagattatgtaactcctccatccatgtgttccaaatttgctttacatatgattgtatttgtgtataggggaaaatattatttttatgcctggtaagtggctttttgtactgtagttcagatagagatattttgggtatattttcaagatacatgttgtatttatggaagaaagagttgtcctgatgtttttctgtgttacttatattagagtcagagatcttggtatgggctgttctgtttcctgtgtctccaagcctctgtcttttctgggatgtggtattggtgctttgtgtctagggcagagtatgttcttgaagaaaggcaaatctgactttttctgtgcgccttaaacaattcttgtaactttcttcaaaaagcattttaatgatattggaggaatacttctgataatttattgtctttatttttatcccaggaaataaaaggttaccttgttaaaaaaaaaaaaaaaaaaaaaaaaaaaactcggtcaccttgtcagcaacactgttgtcccttcgccccgccgttctttctcttgctgcatttggccattagccaaatttgaacccaattcaatnataacgggtctggacactgattttgttttanctcaataaatgtataggctac

SEQ ID NO: 68469 - DNA, 862 bp, Homo sapiens
ttttcggctgcttggtaacgggctgccagaagagagaggcagagagcagggcagcggcttcttgacgtcagggccaagcgaggggatcgcgccagcaaccccagctctccccagagaggggccggccgacgctggagcggagcctgacgccaggcgcccgcggagcgtgagtagggggcgcgggagccggtcagctggggcgcagcatgccctctgatccccccattttctctattctttccatgacacccaagggtcgcctatttttaaaaagtaccacattccatgacgcaggagctgtggaaatggtgagcgctgtgagatggatgtatttgtagccagtctcctatacccagcagagggataacccaaacaaaaatgactctaaatagcccagatcccaagagattatgtaactcctccatccatgtgttccaaatttgctttacatatgattgtatttgtgtataggggaaaatattatttttatgcctggtaagtggctttttgtactgtagttcagatagagatattttgggtatattttcaagatacatgttgtatttatggaagaaagagttgtcctgatgtttttctgtgttacttatattagagtcagagatcttggtatgggctgttctgtttcctgtgtctccaagcctctgtcttttctgggatgtggtattggtgctttgtgtctagggcagagtatgttcttgaagaaaggcaaatctgactttttctgtgcgccttaaacaattcttgtaactttcttcaaaaagcattttaatgatattggaggaatacttctgataatttattgtctttatttttatcccaggaaataaaaggttaccttgtt

SEQ ID NO: 68470 - DNA, 518 bp, Homo sapiens
ctcctgcctcagcctcccgagtagctgggattacaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccaggtaccgcctgccctgccttgtgcttgccctgtgtggggtcatcccgtctcctacctcaggcctggctacagtgggaccatccctgtggtgttcctccagggtccctcggtgcccaggccgagggagggcttcccagcgg

SEQ ID NO: 68471 - DNA, 1723 bp, Homo sapiens
tttcagagaacacagggttcctgcaggaaatggggcagtttcaccttcctgaggaggggcctgggaggggcagcaggtggccgggtagggccagcccagctgtgagcctggcgtgggagctgcctaggccgggccctgccagggagcaagtctgcatcgcagaggccagggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcaca

SEQ ID NO: 68472 - DNA, 1782 bp, Homo sapiens
cctctggtgcctctcctggcaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccggtaggtggggtgtgagcggccaagggggccgaagggggagggcctcactcgggacccatacctgctgctccctggacagaccatctggatcacatcaaggaggtggcaggagccagagccgtgggttttggtggggactttgatggtgttccaaggtaaggggctgagagctctgtcctgtggatgagccgggaggttcatggcctcgtcagagggatgaggtggctggaggagggacctgtgtcctagtgtgggggcccaggttctcctggcctcaacacagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcaca

SEQ ID NO: 68473 - DNA, 1601 bp, Homo sapiens
cctctggtgcctctcctggcaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcacaatcctggggtacgtgtcatcggcatc

SEQ ID NO: 68474 - DNA, 1059 bp, Homo sapiens
cctctggtgcctctcctggcaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacatctcctgagaggacgcctgggcttacctggggggcaggatgcctggggacagttcaggacacacacacagtaggcccgcaataaaagcaacaccccttcaca

SEQ ID NO: 68475 - DNA, 1742 bp, Homo sapiens
cgggggggtactgtgcgagccctcaaggaggtggctgttctgtagctggagagctccgtgggtggcaggactgaacttgaacaccagaaacaacccccaagccttgtgacctgggaggcaggaggcgggtctgtctccctgggacttgggtggctgagccgaggtactcgggaccctgtcccgcgcatggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcaca

SEQ ID NO: 68476 - DNA, 1575 bp, Homo sapiens
cctctggtgcctctcctggcaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcaca

SEQ ID NO: 68477 - DNA, 1884 bp, Homo sapiens
  misc_feature (1620)..(1621): n is a, c, g, or t
cctctggtgcctctcctggcaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcacaaaaaaaaaaaaaaaaaaaaaaaaaaaaaaaaaaaaaaaaaaaaannggggggggccccaaaaaatatccccccaggggggccccagttaggcgtgataaaccccagtgtttgtgatgtacaacaagaggagggcccccacaaacaggagaggcgctcgatattaaaaaagcaagaagacccgggggccagcacgattataaacaaagcgttgtgctacgcggaaaaaacgtggctaaagggggcaaatttgggaagagaaaacccctcaaaaagagcggggcggaacacatatggggacaaatcaccgt

SEQ ID NO: 68478 - DNA, 1658 bp, Homo sapiens
cctctggtgcctctcctggcaggcagagtggctcctcacagcctgaagctcatccttctgcacgggccagccaggccagcacagaggcaccagggcagcagtgcacacaggtccccggggaccccaccatgtggagcggatggtggctgtggccccttgtggccgtctgcactgcagacttctttcgggacgaggcagagaggatcatgagggactcccctgtcattgatgggcacaatgacctcccctggcagctgctggatatgttcaacaaccggctgcaggacgagagggccaacctgaccaccttggccggcacacacaccaacatccccaagctgagggccggctttgtgggaggccagttctggtccgtgtacacgccctgcgacacccagaacaaagacgccgtgcggaggacgctggagcagatggacgtggtccaccgcatgtgccggatgtacccggagaccttcctgtatgtcaccagcagtgcaggcattcggcaggccttccgggaagggaaggtggccagcctgatcggcgtggagggcggccactccattgacagcagtttgggcgtcctgcgggcactctatcagctgggcatgcggtacctgaccctcacccacagctgcaacacgccctgggctgacaactggctggtggacacgggagacagcgagccccagagccaaggcttgtcaccctttgggcagcgtgtggtgaaggagctgaaccgtctgggggtcctcatcgacttggctcacgtgtctgtggccaccatgaaggccaccctgcagctgtccagagccccggtcatcttcagccactcctcggcctacagcgtgtgcgcaagccggcgcaacgtgcctgacgacgtcctgaggctggtgaaacagacagacagcctggtgatggtgaacttctacaacaattacatttcctgcaccaacaaggccaacctgtcccaagtggccgaccatctggatcacatcaaggaggtggcaggagccagagccgtgggttttggtggggactttgatggtgttccaagggtccctgaggggctggaggacgtctccaagtatccagacctgatcgctgagctgctcaggaggaactggacggaggcggaggtcaagggcgcactggctgacaacctgctgagggtcttcgaggctgtggaacaggccagcaacctcacacaggctcccgaggaggagcccatcccgctggaccagctgggtggctcctgcaggacccattacggctactcctctggggcttccagcctccatcgccactgggggctcctgctggcctccctcgctcccctggtcctctgtctgtctctcctgtgaaacctgggagaccagagtcccctttagggttcccggagctccgggaagacccgcccatcccaggactccagatgccaggagccctgctgcccacatgcaaggaccagcatctcctgagaggacgcctgggcttacctggggggcaggatgcctggggacagttcaggacacacacacagtaggcccgcaataaaagcaacaccccttcacaaaaacaaaaaacataaacaaaacaaagaaaaaaaacacatacaaaaactaaacaacaacacaaacaaataacaaggaaacaca

SEQ ID NO: 68479 - DNA, 2254 bp, Homo sapiens
gatccacaattcattgcgcagttgatggaacagcttgatgtcttcatcagtattaaaccaaagcccaaacagccaagcaagtctgtgattgtgaaaagtgttgagcgaaatgccttaaatatgtatgaagcaaggaaatgtctcctcggacttgaaagcagtggggttaccatagcaaccagtccatccccagcatcctgccctgccggcctggcatgtcccagcctggatatcttagcttcagcaggccttggactcactggactaggtcttttgggacccaccaccttatctctgaacacttcaacaaccccaaactcactcttgaatgctcttaatagctcagtcagtcctttgcaaagtccaagttctggtacacccagccccacattatgggcacccccacttgctaatacttcaagtgccacaggtttttctgctataccacaccttatgattccgtctactgcccaagccacattaactaatattttgttgtctggagtgcccacctatgggcacacagctccatctccccctcctggcttgactcctgttgatgtccatatcaacagtatgcagaccgaaggcaaaaaaatctctgctgctttaaatggacatgcacagtctccagatataaaatatggtgcaatatccacttcatcacttggagaaaaagtgctgagtgcaaatcacggggatccgtccatccagacaagtgggtctgagcagacatctcccaaatcaagccccactgaaggttgtaatgatgcttttgttgaagtaggcatgcctcgaagtccttcccattctgggaatgctggtgacttgaaacagatgatgtgtccctccaaggtttcctgtgccaaaaggcagacagtggaactattgcaaggcacgaaaaactcacacttacacagcactgacaggttgctctcagaccctgaactgagtgctaccgaaagccctttggctgacaagaaggctccagggagtgagcgcgctgcagagagggcagcagctgcccagcaaaactccgaaagggcccaccttgctccacggtcatcatatgtcaacatgcaggcatttgactatgaacagaagaagctattagccaccaaagctatgttaaagaaaccagtggtgacggaggtcagaacgcccacaaatacctggagtggcctgggtttttctaaatccatgccagctgaaactatcaaggagttgagaagggccaatcatgtgtcctataagcccacaatgacaaccacttatgagggctcatccatgtccctttcacggtccaacagtcgtgagcacttgggaggtggaagcgaatctgataactggagagaccgaaatggaattggacctggaagtcatagtgaatttgcagcttctattggcagccctaagcgtaaacaaaacaaatcaagtgagctttgtgttttatgcacacttttaggtatccccagattagaatgtgtttatttgggttggagtatcactgactgtggcctctctgacttcaagtgcttggtgtaattcacatgccatctcctctgtgaagcctccttgtttctcccagtgaagcaggccacctggttctctttcctctcactccattttgtgcgtgctttcactctagcacttgccataccaaagggcaattatttatctacctatctgtatctccttgtgaaatttgtgctccacaaaccaaagactgtatttgttcattttataaacatttatgaagtgtccatgtgtcaagtattctgttatgctctgccttattggatatttcttcccaaacgcctagtgaactgtctgacacctagtaggtaggtgctcagtaaaagtttgtgaaatgaatgcatgaatgggtaatgtacacacatgcatccaggtggtgacaaaaagacaaggacataagaaagtggttgaggccaggcatggcagctctcacctgtaatcccagcactttgggaggtgaaggtgagttgatagcttgagcccaggggtttgagaccagtctgggcaacatagtgagatttcatctctactaaaaaaaaaaaaaaaaaaaacaagaggctgggtgtggtggtatgcatgcgccaatagtcttagcctacgtgggagactgaggtgggaggatcgcttgagcccaggagtttgaggctgcagtgagctgtaattgaaccactgcactacagcctgggtgacagagcgagaccctgtctcaaaaaaaaaa

SEQ ID NO: 68480 - DNA, 1763 bp, Homo sapiens
gatccacaattcattgcgcagttgatggaacagcttgatgtcttcatcagtattaaaccaaagcccaaacagccaagcaagtctgtgattgtgaaaagtgttgagcgaaatgccttaaatatgtatgaagcaaggaaatgtctcctcggacttgaaagcagtggggttaccatagcaaccagtccatccccagcatcctgccctgccggcctggcatgtcccagcctggatatcttagcttcagcaggccttggactcactggactaggtcttttgggacccaccaccttatctctgaacacttcaacaaccccaaactcactcttgaatgctcttaatagctcagtcagtcctttgcaaagtccaagttctggtacacccagccccacattatgggcacccccacttgctaatacttcaagtgccacaggtttttctgctataccacaccttatgattccgtctactgcccaagccacattaactaatattttgttgtctggagtgcccacctatgggcacacagctccatctccccctcctggcttgactcctgttgatgtccatatcaacagtatgcagaccgaaggcaaaaaaatctctgctgctttaaatggacatgcacagtctccagatataaaatatggtgcaatatccacttcatcacttggagaaaaagtgctgagtgcaaatcacggggatccgtccatccagacaagtgggtctgagcagacatctcccaaatcaagccccactgaaggttgtaatgatgcttttgttgaagtaggcatgcctcgaagtccttcccattctgggaatgctggtgacttgaaacagatgatgtgtccctccaaggtttcctgtgccaaaaggcagacagtggaactattgcaaggcacgaaaaactcacacttacacagcactgacaggttgctctcagaccctgaactgagtgctaccgaaagccctttggctgacaagaaggctccagggagtgagcgcgctgcagagagggcagcagctgcccagcaaaactccgaaagggcccaccttgctccacggtcatcatatgtcaacatgcaggcatttgactatgaacagaagaagctattagccaccaaagctatgttaaagaaaccagtggtgacggaggtcagaacgcccacaaatacctggagtggcctgggtttttctaaatccatgccagctgaaactatcaaggagttgagaagggccaatcatgtgtcctataagcccacaatgacaaccacttatgagggctcatccatgtccctttcacggtccaacagtcgtgagcacttgggaggtggaagcgaatctgataactggagagaccgaaatggaattggacctggaagtcatagtgaatttgcagcttctattggcagccctaagcgtaaacaaaacaaatcaagtgagctttgtgttttatgcacacttttaggtatccccagattagaatgtgtttatttgggttggagtatcactgactgtggcctctctgacttcaagtgcttggtgtaattcacatgccatctcctctgtgaagcctccttgtttctcccagtgaagcaggccacctggttctctttcctctcactccattttgtgcgtgctttcactctagcacttgccataccaaagggcaattatttatctacctatctgtatctccttgtgaaatttgtgctccacaaaccaaagactgtatttgttcattttataaacatttatgaagtgtc

SEQ ID NO: 68481 - DNA, 2161 bp, Homo sapiens
tttaaaactcaggttgtatatatatactatatttttaaaaacatgatttatattccataatagctatagcagtataaattttaagcattttattatgataaatgtaatatctgtaataaaaattgactgttagccaaatagagaactaggtactcccccaaagtctggatcagctctacaaattagacctatgctcaagtgaaatagcttaagtaatgggttggactttgaagaaattgattttggctagttgatatgtattgtttttgtttaattctgtctgcctccactattaccatatactactcaaggtgataaagttattcccttgacttttttttaaacagccattcaatagtactttaaattcaggaatacacaaaagtgtttgttcacaaaagtattcctgaatttaaagtactactgaatggcagttggaaaaaaacacatatttatacacacacatatatatacatatacacatacatatgcacatgtgtgtgtataactttcaaaacttgatactcattcctagaaccaattatttgctttgctgttaatgttacctgaaaggttcttctctgtcctctctgttctctagtttttaccagtttaatatcttatatacaacctttccctcaatctctgcagcccatgttgaccttatccgactttggccttcttacatatacactttttgtcttattcaaagttatcctggctcagagtattctctagttgtcacatatgtgctttttttcactaataggagcagtaagctccttgaaagtaagagcttttttctcattatatttctacctgacaagcacagtgttaggcatgtaatagatgttcaataaattaaaaacttaatgaattgaattttttaatgttcaattttaactttttaacgttaaaccatcaattcaacctatctattttggaatatatttttagtatatttttgactaaaatgttagatttttttttctctccaggtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgga

SEQ ID NO: 68482 - DNA, 463 bp, Homo sapiens
gtattgtgatatgtaccaaagctatccgaaactcctttatttctaatatgacttagtgtatgttactaataattataattgttatgtaaaattttgtatgcccaaaagtaaggattggagagttagtactttatagaccaatattttgtttagatggattgatgttttgaatgtatgctattcaagtaacccttcttaattatatataatggtatgaaaaaagtttttaatcccttttaatcttatgattgtggaattatggttttgatggccattattactatttattcagatatgaatggagtgagtgttctctgtgccatttgttgtgggggacaggagatgctatttgggaattctggccactgccatatgcttagcttgtggataaaataatggagagaacagtaaacttaactttggctactcttttattacgtaaataaaaattaatgttcaatac

SEQ ID NO: 68483 - DNA, 2654 bp, Homo sapiens
cgcgacgttgcctgtgggtgcccgcgaaccaacggttagcggtggcaggggctgactgagagcgtctgcttgacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgga

SEQ ID NO: 68484 - DNA, 3236 bp, Homo sapiens
cgcgacgttgcctgtgggtgcccgcgaaccaacggttagcggtggcaggggctgactgagagcgtctgcttgacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctggaagcctatgggaactagtacaactcttctgaactcttggtttctcactcaaatcctctgaggcaactggggaactagagtcatgaactgaattagaaatagaggacagagagaaaagatataatagaatggaggagctcaaatatagggtagcagtttaagagatggtgattcctaagggacagagttggaagtacatatttactgaattctttgaacccacagctgatggaatgttcaagctatagatgtgaaagaatttttaggtcaggatcttgggaagctaaggagagcaatttttaaaagacagtttttctgttttcctaggaaattcccaagaagcttgtgtaggaaaaagttggtaattatggatcttttggggaggaagagaactataattcattctaatggtgaggagagataccatgttagaataccttccatacctggaagtggggaagtgactgaagatgggcacattgatgcttgaaattgtccttgaaagtagttaatggcagagatcaaaatttcctcctgttgtaaatagtgcatgtgccctttgccagctttcactcccactcatt

SEQ ID NO: 68485 - DNA, 3162 bp, Homo sapiens
gggcagccgtagtctcggcgggcggcggtgaaaaaaagcgtcccccagccccgccaattcggcacccccgggaagacgctacttctccgatccctgagccctcgcccaccaccgccgagccagagggcacagggcggccctggcaatcctcgagcgccaggctgggccgcggagctggcggggcggcggggcccgaggcgcaaagcccgcccttcgcccagccccatcggtggggatcagcccagagggcgggagcagggagtggagacggggtcctcacccccagcccctcccctttctccgcccggcacaaaccgggagccgccccggccccagcgccttcttccccgcccaggcagacgcgacccgccgaggcaaagccttaggaaaaagccccgccctctggcaggctaccctccggaccccaagtgcgccgcgcgcggctgccagccactgccggctgctacgcatgcgtgactgcgaactgggccaagcgcccccggaggcgctaagcttgcgccctgaggcggtttccgttcccggacgtttggactctgtcctggagaaggggaaggaaaaaacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgga

SEQ ID NO: 68486 - DNA, 2527 bp, Homo sapiens
atatttcctagaaaatggatcctcacttcttcacttggatataataatatagactgccgacattctgggaactgatcagtcttccagcttccagtgtggtgccctccctcaattgtgctgagtgtcccccaatccagagatattctgtaatttcttcctcagaaagaaacaaaacaaaattctgatcttcccagatgaagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgga

SEQ ID NO: 68487 - DNA, 2399 bp, Homo sapiens
cgcgacgttgcctgtgggtgcccgcgaaccaacggttagcggtggcaggggctgactgagagcgtctgcttgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgga

SEQ ID NO: 68488 - DNA, 2491 bp, Homo sapiens
cgcgacgttgcctgtgggtgcccgcgaaccaacggttagcggtggcaggggctgactgagagcgtctgcttgacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgga

SEQ ID NO: 68489 - DNA, 1995 bp, Homo sapiens
cgcgacgttgcctgtgggtgcccgcgaaccaacggttagcggtggcaggggctgactgagagcgtctgcttgacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaaggtgtgcatataaaattttttcccaaacaaaaatactgctaatacttatttatataacctcttaatccttatacctacccctttccaaaaaggatttgaagatataaaataaaagacatgcaataatgcgtgtcaagtaatggatgatggtttggggtataaggacagaaaatttcataagattcaggttaaaaaaagtagcagcagtcatgtacaaaatttagctctgagtttgcttgacaaccaaagcaaaaaggaacatataatggacagtatagctatctttgtgaaataacaggaagcactccagtttttctagaaagattaacatttttctagttttaaacttctggagaaacatattttgtgatagtttataaaagaggcagtaaacaacacagtagatactgacaacataataaatcctgaaagcagttttatgtaatatatagacaataaaaaataaggtttttcttatagacctgttaagtctgtaaagtcatttatatagggaatttattgttatatgtaatttctatgcttatttcttgtgaatttgcccaaaagtaaggattggagagttagtactttatagaccaatattttgtttagatggattgatgttttgaatgtatgctattcaagtaacccttcttaattatatataatggtatgaaaaaagtttttaatcccttttaatcttatgattgtggaattatggttttgatggccattattactatttattcagatatgaatggagtgagtgttctctgtgccatttgttgtgggggacaggagatgctatttgggaattctggccactgccatatgcttagcttgtggataaaataatggagagaacagtaaacttaactttggctactcttttattacgtaaataaaaattaatgttcaatac

SEQ ID NO: 68490 - DNA, 1276 bp, Homo sapiens
  misc_feature (15)..(15): n is a, c, g, or t
cggctgcttccgccnccgcggttttgctatcgtcgatccacgcggcccgcctcaagcgtacggggccatcacaggataacaaatctccaaacgtgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgga

SEQ ID NO: 68491 - DNA, 843 bp, Homo sapiens
gggcagccgtagtctcggcgggcggcggtgaaaaaaagcgtcccccagccccgccaattcggcacccccgggaagacgctacttctccgatccctgagccctcgcccaccaccgccgagccagagggcacagggcggccctggcaatcctcgagcgccaggctgggccgcggagctggcggggcggcggggcccgaggcgcaaagcccgcccttcgcccagccccatcggtggggatcagcccagagggcgggagcagggagtggagacggggtcctcacccccagcccctcccctttctccgcccggcacaaaccgggagccgccccggccccagcgccttcttccccgcccaggcagacgcgacccgccgaggcaaagccttaggaaaaagccccgccctctggcaggctaccctccggaccccaagtgcgccgcgcgcggctgccagccactgccggctgctacgcatgcgtgactgcgaactgggccaagcgcccccggaggcgctaagcttgcgccctgaggcggtttccgttcccggacgtttggactctgtcctggagaaggggaaggaaaaaatgggactgtctagttgcaaaaacaagctcagggatcccactgattctactttacgataatggattctgaattaatgcatagtatagtaggaagctatcataaacctccagaaagagtatttgttccctcattcacccagaatgaaccacaccagtgggccatccactaaactgaagtcccatcatagatactccacctgttcacctgaagaggtgagtaaagcaatggagtgtaaccacagaattctgagcagaagatccaa

SEQ ID NO: 68492 - DNA, 727 bp, Homo sapiens
gggcagccgtagtctcggcgggcggcggtgaaaaaaagcgtcccccagccccgccaattcggcacccccgggaagacgctacttctccgatccctgagccctcgcccaccaccgccgagccagagggcacagggcggccctggcaatcctcgagcgccaggctgggccgcggagctggcggggcggcggggcccgaggcgcaaagcccgcccttcgcccagccccatcggtggggatcagcccagagggcgggagcagggagtggagacggggtcctcacccccagcccctcccctttctccgcccggcacaaaccgggagccgccccggccccagcgccttcttccccgcccaggcagacgcgacccgccgaggcaaagccttaggaaaaagccccgccctctggcaggctaccctccggaccccaagtgcgccgcgcgcggctgccagccactgccggctgctacgcatgcgtgactgcgaactgggccaagcgcccccggaggcgctaagcttgcgccctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaacccc

SEQ ID NO: 68493 - DNA, 2963 bp, Homo sapiens
gggcagccgtagtctcggcgggcggcggtgaaaaaaagcgtcccccagccccgccaattcggcacccccgggaagacgctacttctccgatccctgagccctcgcccaccaccgccgagccagagggcacagggcggccctggcaatcctcgagcgccaggctgggccgcggagctggcggggcggcggggcccgaggcgcaaagcccgcccttcgcccagccccatcggtggggatcagcccagagggcgggagcagggagtggagacggggtcctcacccccagcccctcccctttctccgcccggcacaaaccgggagccgccccggccccagcgccttcttccccgcccaggcagacgcgacccgccgaggcaaagccttaggaaaaagccccgccctctggcaggctaccctccggaccccaagtgcgccgcgcgcggctgccagccactgccggctgctacgcatgcgtgactgcgaactgggccaagcgcccccggaggcgctaagcttgcgccctgaggcggtttccgttcccggacgtttggactctgtcctggagaaggggaaggaaaaaatgggactgtctagttgcaaaaacaagctcagggatcccactgattctactttacgataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgga

SEQ ID NO: 68494 - DNA, 2755 bp, Homo sapiens
cgcgacgttgcctgtgggtgcccgcgaaccaacggttagcggtggcaggggctgactgagagcgtctgcttgattcaggttatgctttctggccagaatactgcataggtgatgttgcgtccttctccaggtttcatatccagaggcacatggtggccttctacctctcacagacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgga

SEQ ID NO: 68495 - DNA, 2236 bp, Homo sapiens
cgcgacgttgcctgtgggtgcccgcgaaccaacggttagcggtggcaggggctgactgagagcgtctgcttgctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgga

SEQ ID NO: 68496 - DNA, 2277 bp, Homo sapiens
cgcgacgttgcctgtgggtgcccgcgaaccaacggttagcggtggcaggggctgactgagagcgtctgcttggttgggaaaccaattagaaaggagtgttctgctagaaacagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtctgtaaactgcagcaaaaagttcaaaactcaaagatgagtgaagcttcaggtattcagcaagaagacagctaccctaaaggatcaaagaacataaaaaatagccccagaaaatgtttgactgacactaacctttttcagaaaaacagcagctttcatccaatacgagttcataatcttcaaatgaaattgagaagagatgatatcatgtgggaacagtaacaaaacagcaaaactgtcaccttaatgaactttgtcagtgagaccttgaattgtctaaagtggttttaatttaatataactttgtgacattttgaatcatgtttctagtttctataaaacatgaagttgcagtatttaaaaattaatgcctaatgacctggtgggttccaaataataaattaattgcttttttatttttcttattgattgaagcccgtaacctcatcttgtcttagaaacattgttggctttgcagatatcttaagctaaatttaagaaattgtactagattgacaatattcaaaattgagttaaatccaagctacaagtaccattcattccacttttcatttagtaggtttggaaccttaaaaaccaatgttcaatgaacagagttcagaaagatcatttagctttcctggtgccttctttctattttgttttagagctgtgaaatgtttttctcttttggaaaaggaaaaacttaatagttacacagttttgtgaagaagcctttaatccaagttttatgagacagtaggaacctatagctacttaatttttaggagacagtaattcagttgcagaagctttcctctgctattcccattctcttttacaaaactagttttttttaaaaaatcaatgatcaattttatcttactactttataacttttgctgacttttattctttgcattgtatgtaatgtccatcagtataaattgagactgtgaatttctaggacccacaaaagtggtattttttttttgtacaagaaagtatagaggaagaggaagctgggcattaaattacctcatccagcagaaattcacggtagtatggtatatttttattttttatattttaaaatcaataatgtcaaatgtcattgtgtatgcatgctttataataaatttacacttgatcatttttctgga

SEQ ID NO: 68497 - DNA, 1541 bp, Homo sapiens
cgcgacgttgcctgtgggtgcccgcgaaccaacggttagcggtggcaggggctgactgagagcgtctgcttgacagagtctttctctgtcacccaggctggagtacagtggcacgatctcggctccctgcaacgtccgcctcccgagttcaagtgattctcctgcctcagccacccgagtagctgggtctacaggtgtgcgccaccatgcctggctaatttttgtatttttaagagagacggggtttcaccatgctggccaggctggtctcgaactcctgacctcgtgatccgcctgcctcagcccctcaaagtgctaggattagagataatggattctgaattaatgcatagtatagtaggaagctatcataaacctccagaaagagtatttgttccctcattcacccagaatgaaccatctcagaattgccatcctgcaaacttagaagttacctctcctaagatacttcatagcccaaatagccaagctcttattttagccttaaaaactcttcaggaaaaaattcatcgtttagagctggagagaacacaagctgaagataacctgaacattctttccagagaagcagcacagtataagaaggccttagagaatgaaacaaatgagagaaatctggcacaccaggagctgataaagcagaaaaaagatataagtatacagttaagctcagcccagtctcgttgtactcttctagagaagcaactagaatatacaaagagaatggttctcaacgtagagcgagaaaagaacatgatcctagaacaacaggcccagcttcagagggaaaaagaacaagatcagatgaagctgtatgcaaaacttgaaaagcttgatgtcttagaaaaagagtgtttcagacttacaacaactcagaaaactgctgaggacaagattaaacatttagaagaaaaacttaaggaagaagaacatcagcgtaagctatttcaagacaaagcttctgagcttcaaactggacttgaaatcagtaaaattataatgtcttcagtttcaaatctaaagcactccaaggaaaagaagaaatcttcaaagaaaactaaatgtataaagagacgaccaccttggcaaatttgttcaaagtttggagcactgccttttgtggctgaaaagatgaggcaacatcgtgacccacatatccttcagaaaccttttaacgtgactgagactagatgtctccccaagccttctagaacaacttcctggtgtaaagctattcctcctgactcagaaaagtccatttccatttgtgacaatttatctgaacttttgatggcaatgcaagatgagctggaccaaatgagcatggagcaccaagaactactgaaacaaatgaaggaaactgaaagtcattcagtctgtgacgacatagaatgtgaactagagtgtttactcaagaaaatggaaattaaaggagaacaaatctccaaactgaagaagcatcaagacagtgtaagaaggctttagtaagagattttaataaaaacacaaaatatctggat

SEQ ID NO: 68498 - DNA, 395 bp, Homo sapiens
ttaatcctgctatcaaatctgagctttaaaaattaattagaagacagaatttagtattctgctataatgcaagttggatttttaaataaacacttaatcctgcaaagaaaacacaattcacagaacaagggagctcaattatttcagcctcttttctcatttcctttcagctgcagggggcagcactgctcagctaatggcttttttctttttcttttttcctttcctaacaaaaggaagagtcatttccttctatacaatgttttcatccctgctctccattgtacaatgtgtggctttcttgaggcactgcctctcgagtccctacctcaaacttcacttcaaataggagattttatgttggggaaagaaggattggtaaagaattcttactt

SEQ ID NO: 68499 - DNA, 494 bp, Homo sapiens
gcatgccctctccccactccaaaatgaattccaaaaccaattattcttctcctgataatgatttgtccctttagcatccgggtattagagaaaggatgaggtggtttgaacctatttaagatgaactgcattgttaagagtttacttagacacgggtctatttacagttaagcagtggttctcaaaacatgtccctggaccagcaatgttgtcatcgggtccagggacacattttgcctgggagtatataagaaatgcaaattctcaggactcaccagaccatcataaactaggagtgaggaccagcaattggtcttttaacaagtcctttgttaaggtcattctgatacatgctagactctgagaagaaagattagaaactactgatcttccaagattagaagcttctgagatgagaagtttggtattcttgctgaatttggattcaggtaatctccagtttaaaaacttttttttagttagctaatgtccag

SEQ ID NO: 68500 - DNA, 445 bp, Homo sapiens
tgccttcacctttgaaagtcagtgcacacagtataatctttttattgtctttgaagcccatgtttatgattgatttaaaaaggtggaacaatttattttgaggttctttgggtaacagtgtacccttgtataggaatcaagatagatctaactttcaccagaagtattcatatacccagtagctttatggtgaggtatttgagtgtttttgtctgaataaggaatattagaccaatttagaaatacttttgccggagaggaccctttcagttttagtacttgatgcatatgaaattcatatgtgttttgtacatgaatagatttatttatcacatagttattgagcacctactatttggcaggcactgttctaggtactaaaaattcagcagttaacaaaacagatgtctctcctcagaggacaatatcttggatattatattct

SEQ ID NO: 68501 - DNA, 139 bp, Homo sapiens
agttaacccaagttctgccaatgctgattggcatagtgtgcatatctcagaattattatgacaatttgcactgtttgatagtctcccagggaaggtgtttgttcttccaaacaaaccaacaaacaaacatccaaggcac

SEQ ID NO: 68502 - DNA, 444 bp, Homo sapiens
ctttttaaaaagtttacatcagagaaccccatatatacacagagttgcccaagggggaatatcccattattcagataaacactgcattgaaccactgcattgctgattacaagatctaaaatacattctaagaaatacgttccaggaaaataaatatatctttatataaaataagtcccaaaactcctagccacacacccctcatatatacacactagatttgggggtaaacttttacaaaaagagggatagatttggtggaaggtaggatgattaaagaaagaaaagtctcagggccatgaatgagtggaagttaaggatatcaaggagcagaggaccaaatttgttgttacattatttggtccacactatccaatctgcaacctttgggaacaagtgttagaaatcaatatttcacattttaaagtgaaaatactgcaatag

SEQ ID NO: 68503 - DNA, 176 bp, Homo sapiens
aaacaaggaaactgaggaccaaaggcagaagaggacatgttggagatcagagtcaggatctagggatagaagccagcgagatgaaggggaactcatctcggagttctgacctctgaggtcaggaggctgtgacctcagaggaagcccatctgctctccaggcctgtttcctcatcg

SEQ ID NO: 68504 - DNA, 581 bp, Homo sapiens
  misc_feature (7)..(7): n is a, c, g, or t
gaacctnagaaggaggaaactctggacacatctgaaggaacaaactctggacataacacctataagtgctgtaacactcaccactaatttctgcagcttcattcttgaagagaacaagaccataaacctgccagaaggaagaaactccggacacatctgaatgaacaaactctggacataacaccttttcagtgctgtgagactcaccactaaggtctgcggcttcattcttgaagtgagcaagaccatgaacctgccagaaggaagaatatctggacacatctgaaggaacaacactagacctaacacctttaagtgctgtaacactcaccgtaaaggtctgcagcttcattcttgaagtgagcaagaccatgaacctgccagaaggaagaaactctggacacatctaaatgaacaaactctggacataacacctttaagtgctgtaacactcaccactaaggtctgcagcttcattcttgaagtgagcaagaccatgaatctgccagacggaagaaactccggacacatctgaatgaagaacctctgaacataacacctttcagcgctgtaacactcac

SEQ ID NO: 68505 - DNA, 273 bp, Homo sapiens
agttggttaaaaggttagttcctggggcttacaaatgacatctgcagtgggggcctgttgtgggactgagccctctagcaagaaacttatgggatctgtgttaattctgggtggtataagaattgaactactggacacccagttattgctggagaattggttggtgttcagcgaacggcacacctttgttatcagaagtcagaggcaccacaggtcagagccttaaaccgactgactgttattcagtatatgtttatcatgtatgaatccaga

SEQ ID NO: 68506 - DNA, 6927 bp, Homo sapiens
gatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttg

SEQ ID NO: 68507 - DNA, 6870 bp, Homo sapiens
gatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaatgtaaaaaccacacttctgaacaactaagctcatgaatatgattttggttatatgcagcttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttg

SEQ ID NO: 68508 - DNA, 6869 bp, Homo sapiens
gatggctgagcgcgcaggagcccgggaggtctgagccgggcgaggctcgctccctgcgcatcgcctcctccgcccgccgcgtggtcgcgggcaggtgggccggggggcgctgggcaggggcggggcagggccagggcaggccggtctgcagccggaggggccggagcggagaagctgcccaccttcccgggctcggagcggccggggctgctcagccggccgggctcgcgatgacctgctgagaagcgtcgtcggaggctgcaggaggcggcctagctgtgggcggtgcagctcgcggcctcctccctcgtcgttcccggccccggccccccacccatccccgtgccccctccctaccgccggccgagatggcggatccagccgaatgcagcatcaaagtgatgtgccggttccggcccctcaacgaagcggagatcctccgcggggacaaattcatccccaaatttaaaggcgatgagaccgtggtgatcgggcaagggaagccatatgtcttcgacagagtgctacctcccaacacgacccaagagcaggtttacaatgcatgtgcgaagcaaattgtcaaagatgtccttgaaggttataacgggacgatttttgcgtatgggcagacttcatcaggaaaaacccacaccatggaggggaagctgcatgacccccagctcatggggatcatcccacgaattgcccatgatatctttgaccatatctactccatggatgagaacctggagtttcacataaaggtttcctattttgagatctacttggacaaaataagggacttacttgatgtatccaagaccaacttggctgttcatgaagataaaaacagagtcccgtatgtaaaggggtgcactgagcggtttgtgtcgagccctgaggaagtcatggatgtaatagatgaaggcaaagcaaaccgacacgtggctgtgacaaacatgaatgaacacagctctagaagtcacagtatcttcctgataaatattaaacaagagaatgtagagactgaaaaaaaactcagtgggaaactttatttggttgatttggctgggagcgaaaaggtcagcaaaactggtgccgagggagctgttcttgacgaagctaaaaatatcaataagtctttgtctgctcttggaaatgtgatctctgctttggcagaagggacaaaaacacatgtgccataccgggacagcaagatgactcggattcttcaggactctttgggtgggaactgcagaaccaccatcgtcatttgctgttctccttctgtcttcaatgaggctgagaccaagtccacactgatgttcggacagagagctaagaccatcaagaatacagtctctgtgaacctagaactgacagcagaagaatggaagaagaaatatgaaaaagagaaagagaaaaacaagactttgaagaatgttatccagcatctggagatggagctaaacaggtggaggaatggagaagctgtgcctgaggatgaacagatcagtgccaaggaccagaagaacctggagccttgtgataacacccccatcatagacaatattgctcctgttgttgctggcatctctacagaggagaaagagaagtacgatgaggagatctccagtctctacagacaactggatgacaaggatgatgaaattaaccagcagagccagctggctgaaaagctgaagcaacagatgttggatcaggatgagcttttagcttccacaagaagagactatgagaagatacaggaggagctgacacgtctccagattgaaaatgaggcagccaaggatgaggtgaaagaagttctccaggccctggaggagctggctgtcaattatgaccagaaatcacaggaagtggaggataagacccgggccaatgagcagctgacagacgagctggcccagaaaacgactacattgacaaccacacagagagagctgagccagctacaagagcttagcaaccaccagaagaaaagggcaactgagatcctgaatttgctgttgaaagatctgggggagataggtggaattattggcaccaatgatgtgaaaactttggcagatgtgaatggagtcattgaggaggagtttaccatggcccgcctgtacatcagcaagatgaagtcagaggtcaagtccctggtgaaccgcagcaaacagctcgagagcgcccagatggactccaacaggaagatgaatgccagcgagcgggagctggcagcctgccagctgctcatctcccagcacgaagccaagatcaagtctctgacagactacatgcagaacatggaacagaagaggaggcagctagaagagtcccaggactcgctcagcgaagagctggcaaagctccgagcccaggaaaaaatgcacgaagtcagcttccaggataaggagaaggaacatctgacgcggttgcaggatgctgaagaaatgaagaaggcgctggagcagcagatggagagccaccgggaagctcaccagaagcagctgtccagactccgagacgaaattgaggagaagcagaaaatcattgatgagattcgggatttgaatcagaaactgcaactggaacaggagaagcttagttctgattataacaagctgaaaatagaggaccaagagagagaaatgaagctggaaaagctcttattgctcaacgataaaagggaacaagccagagaagacctcaaagggctggaggagacagtgtctagagaattgcagacactgcacaaccttcggaaactctttgtccaggatctgaccacccgagttaaaaaaagtgtggagttggacaacgatgatggagggggcagtgctgcccagaagcagaaaatttccttcttggagaataacctggagcagctcaccaaagttcacaagcagctggtccgggacaacgcagacctgcgctgtgaactgcccaagctggagaagcggctgcgtgccacggcggagcgcgtcaaggctctggagagcgcgctgaaggaggccaaggagaacgccatgcgggaccgtaagcgctaccagcaggaggtggatcgtatcaaggaggccgtgcgggccaagaacatggccagaagggcccattcagcccagatcgccaagcccatccgccccggacactacccggcctcatctccaacggccgtccatgccattcgagggggaggaggcagctcttcaaattccactcactaccagaaataaatacaaaatatgactccacgtagcatgtcaaggactacattaatcaccaattcctttatttttccccccctacagtttccattttttttttatacttgcttactccagccatctgcagtacaccagtttcaggtcttttgagctgtgtagagtttctgtgtgtacagatgtgtgctcggacttttctctttttgagaaatctgaaggagatggttgcagaagatccacttactactgagaaccattaccaccgactcggcctccggggtgttgggtggtttctgggtggttcctggagcctcctctgggcagtgcactgtcccatctgtacgccctaatgtgccattccctagaggggaacaaccaagtgccgtggaggcagatgatcatggtctgcctcaactgtctggtttcctgtaaaataaacacattgttttatatttttagggaacaaaaagtgctgctatagggttcaaagttttccttctgaacacttttccgaaacaaattaccccaaagacacattttgaatatcctggtcacatctttggatctgtaaaatataccttttagtatggcacctgttaaaatgcaaagcaaatttctttggggcagaaaaacaatctgacagtagcagtgtagaatttgttcattcaaatacatctgtgtaaatgcaaaaagtcataaaattcacctccgagctgcttgcttttgaacctgcagcaactagtcttagccggcccggtttgaacatcgttctttcagaagtgctgaaaatgctgcaaagttggataagtggaaatgtggctgcccctctcctcactacttcctctctgatcgttctgaagcttgcattgggaatggctgctttctctaaccattttcagcttgagtgggtattgctgaagaaatccaacatcattccagcagttgaaaaaggaagccttcgggagaaagtgcttgtcaaaattttgttctttgtgcttgtgtatgagtaagttgccatgaataagttattattttaacccataattggcgactgtttatatgaattctttctttggcaccaaataggtttcatcttcttaggcacaattagaaaaaatccacatagatggatattttacatttagttattgctttatccaaatacatgaatctaaagctgaatcaacccttacttccagttgtgcttattaagaagatcaatttccaagtagtaaagttttcagggaaactgactgtgctgctatttgttttgacaaatttgggggtaagtcaatgacaaccaaaccaatctcggtggaaactcctatcctatcatgttgtgtgcccaagatgagtgagctggcactgtgccctgaagctttcaccactgtaatgaaatatatgccaggggagactttgggcttttctcatgactgtgtgggtcgaaggtagctcaagtgtgtgtgtgtgtgtgtgtgtgtgtgtgtgtgtgtgtgtgtatgtgtgtaaagtgctaagaactgtgcattgacatccaaacatttcttgtacaaaatttccctagcaaagcaaacctgctttgacttaatttatttgttaaatgttgcactttgtttatgtatgttttgtttttggtggggaataaggagagagaggacgacaaattctattgaagtatttattttgtgaagatggcaattttgcatttgtttaaatttttttcattctttaattttgttatcagtgccagcccaatatacctgctctaccattatttgcggtctgataaaagggtccttgtggggcaggttttgcaaagcttatcaggtaataacatatgccacataaccttgttgatatgtttgcttctgatttgggaagctaaacattggtgtttgagaggattgccaattattaattgtcattaccactactctccattactttttgtttggaaattgaacaaaggtcagtaatggtttttggctcttgttaatatccatcataaaatagattgttttagattctttccagggtgatttttccctgggtaccccgtttctacttctaaagaattgcttggcactttcatgtttcaaagggaaacattcgcttgtagttccattttacttgatctctacaagggactgacaacatttgctttacttttattcacagagaaagttggctttgatgtctcttaaagataattctgctagttgctgatcagccagtcagttcacctagcttcaatctttataggacttctaatctaattttcctatagtgtgactaaaagggaggcaaattattggaacggattattcaaatggatccttaaatattgctatgtataataagccagttattatatcaggaccatgttctctgtaggccactttctaaaaaagccacatatgtgcaattttcaggtttttagactattgctccctgtactttaaacttttgactagcatgtattgtgtctttttctcctctatgaataattttatatttcatgctacttcttgaaagtttactctttgatgctctaagagaacagccagatggtttatatgaataatctttatctgcaggatggtggattggtaaattaggagaatgttgtttgagatatcaagatttatgtctgggaactaaaatatataatgccaaatgtgtttttgtcaattactagagaattctgtgcaaacatatcatctcttcaaatgctgcacactttgcttttgttaaacagcaggtagtagacagaacaataacagtttcgcgttaagacttttaaaggaaatagaatcgtgattaagaaatcagaatttatagatatattgggataaatgaagaaataaaaatgtttgtctagaatgtagcatctagtgactttttaaagccctaacgtttacataaagaagctctagttcttatagaaataacaaagcaaataaaagttcttaacaatcccctctttcgaagtgcatttttttaaagcagggcaggagacatttggactctagctatatgacatactgggaaaggcagagggtggagggaagatttcacttcattgtctagcccagaatcttgagcaagctaaagaaaccatcataatctaaaattgcttcatttaacactaacaatttagactttttaaaccaagcattgaataatggctggataactgccgaagtaagcgccgctccatgaagtctgcttacttatttaaaaattgtgtatcagttttaaatactgttcattgtgtgcagatataaggggaatagggcattctgtagaattatacatgtctagtttgtaaagtgtgtcctgtgtactgcagatgtgtgttctctgggctttatgtatctgtacagtagctttcacattaaaaaaattgtggacaaacttgtccggggggtttgaggggagaatggtggtttatatcaataacgatgctgtactatagtccatgtaacaaaagatctggaagtcaccctcctctggcccacggaaaattttggtaatcttctaggttctaaaatgaagatgtatgggtactctggcagactgcatgttgtataatttgaaaaatactaaaagtggaaaataaaattgaattaaactttg

SEQ ID NO: 68509 - DNA, 425 bp, Homo sapiens
ccaaacgggaaagagagtggcagaaaaactttgaggaaagtcgagatggtcgtgtggacagctggcgaaacttccaagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctaggaacaaccagtattaggaagggtggccaccattggtgctgccttctct

SEQ ID NO: 68510 - DNA, 459 bp, Homo sapiens
cctaacaaactgaatctcgaggaatcatcgtcacaatcgaacagaaagctgtcaaacaatcgcacatggaccgtcgttatcgtcgttcgctactagaaccatcccgtgcgagccaatacgaaggggaagaaagagaagaaaaatcggaccttcctgagaccaccgaaagtaaaaatggagcaacgtgagtgaccgcccaaggtcacaggcacagaacctttcccctgctatctcccttcctgcttcgaaggactcattctttcctcccacttccaccccaacatagagtagtatttgctttttagtccattttgttttcaatacgatttaatatcgatcagagtaattcttttgtacattgaaatgaggggcttggtttaaaaaaagacctttccctctccctgcccctaggaacaaccagtattaggaagggtggccaccattggtgctgccttctct

SEQ ID NO: 68511 - DNA, 2308 bp, Homo sapiens
agaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatgtgctctatgcccaggtctctgtggctgggctgctccagcctggcggacagcatgccttcgctgcgatgcctgtataacccagggactggcgcactcacagctttccagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcaattgtgaatgattggaacttttaaacctcccctcctctcctcctttcacctctgcacctagttttttcccattggttccagacaaaggtgacttataaatatatttagtgttttgccagaaaaaaaaaa

SEQ ID NO: 68512 - DNA, 1512 bp, Homo sapiens
  misc_feature (1428)..(1429): n is a, c, g, or t
  misc_feature (1439)..(1439): n is a, c, g, or t
  misc_feature (1441)..(1441): n is a, c, g, or t
agaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatgtgctctatgcccaggtctctgtggctgggctgctccagcctggcggacagcatgccttcgctgcgatgcctgtataacccagggactggcgcactcacagctttccagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttggtgccgnncttggtcggntnggggttgaacttttgtttggacccagttcttggtgattgggggccttatggccaagggctgcggtgcgcag

SEQ ID NO: 68513 - DNA, 1400 bp, Homo sapiens
  misc_feature (1316)..(1317): n is a, c, g, or t
  misc_feature (1327)..(1327): n is a, c, g, or t
  misc_feature (1329)..(1329): n is a, c, g, or t
acctgctttaggtgatcctggattattgagccatgaagatgttggtggtgggatgtcaggagcagacaatgtcaatgactcatggtcaagtagcatgtacagtgtggatacactggaccaagggataattcacatcctgggcaggacagagctaccagaaagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttggtgccgnncttggtcggntnggggttgaacttttgtttggacccagttcttggtgattgggggccttatggccaagggctgcggtgcgcag

SEQ ID NO: 68514 - DNA, 1893 bp, Homo sapiens
  misc_feature (1809)..(1810): n is a, c, g, or t
  misc_feature (1820)..(1820): n is a, c, g, or t
  misc_feature (1822)..(1822): n is a, c, g, or t
aaataccattgattttcaaaaacttaatacaaaaaagtgaaatatctaattcataattctatattaattatattttgaaataatgtttaggccaggcgcagtggctcatgcttgtaatcccagcgttttaggaggccgaggtgggaggatcagttgaggccaggagtatgagacctgcctgggtaatatagcaagaacttgtctgtaccaaaaaaattaggcgtagtggtatacacctgtagtcccatctacttggaaggctgaggcaggaggatctcttgagctcaggagtttgaggttctagggagctgtgatcataccactgcactccatcctggttgacaatgagaccatgtctcttacaaaaaagtgaaaagaaagttgaaattttcataatgtattttatttaacacaccgtaattttttatttttgtttttatttctttggaaacagtctcgctttgttgcccaggctggagtgaagtggcgtgatcttggctcactgcaaactccgcctctggcttcaagtgattctcgtggactacagtgctctatgcccaggtctctgtggctgggctgctccagcctggcggacagcatgccttcgctgcgatgcctgtataacccagggactggcgcactcacagctttccagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttggtgccgnncttggtcggntnggggttgaacttttgtttggacccagttcttggtgattgggggccttatggccaagggctgcggtgcgcag

SEQ ID NO: 68515 - DNA, 2158 bp, Homo sapiens
agaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatgtgctctatgcccaggtctctgtggctgggctgctccagcctggcggacagcatgccttcgctgcgatgcctgtataacccagggactggcgcactcacagctttccagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaatggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatgacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcaattgtgaatgattggaacttttaaacctcccctcctctcctcctttcacctctgcacctagttttttcccattggttccagacaaaggtgacttataaatatatttagtgttttgccagaaaaaaaaaa

SEQ ID NO: 68516 - DNA, 2200 bp, Homo sapiens
agaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatgaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtatggaacacaagtacttgtgaatttgtaaggaccttaaatggacacaaacgaggcattgcctgtttgcagtacagggacaggctggtagtgagtggctcatctgacaacactatcagattatgggacatagaatgtggtgcatgtttacgagtgttagaaggccatgaggaattggtgcgttgtattcgatttgataacaagaggatagtcagtggggcctatgatggaaaaattaaagtgtgggatcttgtggctgctttggacccccgtgctcctgcagggacactctgtctacggacccttgtggagcattccggaagagtttttcgactacagtttgatgaattccagattgtcagtagttcacatgatgacacaatcctcatctgggacttcctaaatgatccagctgcccaagctgaacccccccgttccccttctcgaacatacacctacatctccagataaataaccatacactgacctcatacttgcccaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcaattgtgaatgattggaacttttaaacctcccctcctctcctcctttcacctctgcacctagttttttcccattggttccagacaaaggtgacttataaatatatttagtgttttgccagaaaaaaaaaa

SEQ ID NO: 68517 - DNA, 1459 bp, Homo sapiens
  misc_feature (1375)..(1376): n is a, c, g, or t
  misc_feature (1386)..(1386): n is a, c, g, or t
  misc_feature (1388)..(1388): n is a, c, g, or t
agaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatgtgctctatgcccaggtctctgtggctgggctgctccagcctggcggacagcatgccttcgctgcgatgcctgtataacccagggactggcgcactcacagctttccagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaatggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttggtgccgnncttggtcggntnggggttgaacttttgtttggacccagttcttggtgattgggggccttatggccaagggctgcggtgcgcag

SEQ ID NO: 68518 - DNA, 1460 bp, Homo sapiens
  misc_feature (1376)..(1377): n is a, c, g, or t
  misc_feature (1387)..(1387): n is a, c, g, or t
  misc_feature (1389)..(1389): n is a, c, g, or t
agaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatggttcaggctctgttgcaccatccaaccttgagcaagatgcttactcaaagattattaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttggtgccgnncttggtcggntnggggttgaacttttgtttggacccagttcttggtgattgggggccttatggccaagggctgcggtgcgcag

SEQ ID NO: 68519 - DNA, 1481 bp, Homo sapiens
  misc_feature (1397)..(1398): n is a, c, g, or t
  misc_feature (1408)..(1408): n is a, c, g, or t
  misc_feature (1410)..(1410): n is a, c, g, or t
gtgtttgaccgtggcttgatcaccccctccccaataaagctaaaactcacctgagttgtagctggagtgaagtggcgtgatcttggctcactgcaaactccgcctctggcttcaagtgattctcgtggactacagtgctctatgcccaggtctctgtggctgggctgctccagcctggcggacagcatgccttcgctgcgatgcctgtataacccagggactggcgcactcacagctttccagaattcctcagagagagaagactgtaataatggcgaaccccctaggaagataataccagagaagaattcacttagacagacatacaacagctgtgccagactctgcttaaaccaagaaacagtatgtttagcaagcactgctatgaagactgagaattgtgtggccaaaacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcagaacgaagaggatggggacagtatttattcaaaaacaaacctcctgacgggaatgctcctcccaactctttttatagagcactttatcctaaaattatacaagacattgagacaatagaatctaattggagatgtggaagacatagtttacagagaattcactgccgaagtgaaacaagcaaaggagtttactgtttacagtatgatgatcagaaaatagtaagcggccttcgagacaacacaatcaagatctgggataaaaacacattggaatgcaagcgaattctcacaggccatacaggttcagtcctctgtctccagtatgatgagagagtgatcataacaggatcatcggattccacggtcagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttggtgccgnncttggtcggntnggggttgaacttttgtttggacccagttcttggtgattgggggccttatggccaagggctgcggtgcgcag

SEQ ID NO: 68520 - DNA, 4008 bp, Homo sapiens
  misc_feature (1163)..(1163): n is a, c, g, or t
ctttgatttagtaacataaggtatagatgcatgaaaacataaacagtaaggccaggcacagtggctcacgcctgtaatcccaacactttgggaggccgaggccgggggatcacgaggtcaggagatggagaccatcctggctaacacggtgaccccccatctctactaaaagtacaaaatattagccgggcgtggtggtgggcgcctgtagtcccaggtactggggaggctgaggcagaagcatggcgtgaaccgggaggcggagcttgcagtgagccgagattgcaccactgcactccagcctgggtgacagagcaagacttcgtctaaaaaaaaaacaaaaaaaaacaaaaaaaccataaacaatataggagtgtcataggattataaatagatggcatggataataaaatctacaagtttagagaaaattcgtaattataggtgagaagtattaatgaaaggacaaagcttgttcttaaaggatcagaataggccaagatgaaaaaaggcatccatgggaaaagaactgttcatttctataattttaacaaaatagataatctatgttgaataaaatccataaatactatttccaaatttgattaaggtatttactttgaaaacctgaaacaggaacatatttacagtgttaagtgatttgataattttgtagttctgccctaaaaatcaatatccttaattaacccttcatcagtttcttaagtcatctgtcatcctgaaagcaagttaattattctaaatgttaaataattttggtagtgtctaatctataaaacatacatacactaccagtttttttctacctttaacaaattcgttcccataaaagacaattttatcactaacaaaggataactggcaggcaggtaaaggcagcttcttaggcagccagcgagttggcaggtgggttgggactcgcttgtcaactcattaattttaagcagtcagtttgggggtactgcaggataatcaggagggccgtggggagtcaagaggtgacccgggatgccggtggtggggaaagaaaagaggagcctctggaagcttggaggcaaaattgcgcttgggttcctgttccttgcatccctcctggcttgagtgcgggagaacactttttaaagactcaccttggaaagaangcctccgtcccaggggagaaggagaggcgtctgcagggggcagagaccgcagctacctgccgggtgcgccccccacccaggagcgctcgcttcgccccctttcctccccccgcccccacctccttattggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcaccacgctggtggacctcaagtggcgctggaacctcttcatcttcattctcacctacaccgtggcctggcttttcatggcgtccatgtggtgggtgatcgcctacactcggggcgacctgaacaaagcccacgtcggtaactacacgccttgcgtggccaatgtctataacttcccttctgccttcctcttcttcatcgagacggaggccaccatcggctatggctaccgatacatcacagacaagtgccccgagggcatcatcctcttcctcttccagtccatcctgggctccatcgtggacgccttcctcatcggctgcatgttcatcaagatgtcccagcccaagaagcgcgccgagaccctcatgttcagcgagcacgcggtgatctccatgagggacggaaaactcacgcttatgttccgggtgggcaacctgcgcaacagccacatggtctccgcgcagattcgctgcaagctgctcaaatctcggcagacacctgagggtgagttccttccccttgaccaacttgaactggatgtaggttttagtacaggggcagatcaactttttcttgtgtcccccctcacaatttgccacgtgatcgatgccaaaagccccttttatgacctatcccagcgaagcatgcaaactgaacagttcgagattgtcgtcatcctagaaggcattgtggaaacaactgggatgacttgtcaagctcgaacatcatatactgaagatgaagttctttggggtcatcgtttttttcctgtaatttccttagaagagggattctttaaagttgattactcccagttccacgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattactggaagagaagactttcccaaaaaactcttgaggatgagttctacaacttcagaaaaagcctacagcttgggagacttgcccatgaaacttcaacgaataagttcagttccgggcaactcagaagaaaaactggtatctaaaaccaccaagatgttatctgatcccatgagccagtctgtggctgatttgccaccaaagcttcaaaagatggctggaggagcagctaggatggaagggaaccttccagccaaattaagaaaaatgaactctgatcgcttcacataacaaagcactcccttaggcattatttaatgtttgatttagtaatagtccaatatttggcgatgaggtaattctccctaaggaatctgaaagtatattttcctcccagttctacaagcatatttgagaacccttcctttcccaagtattgcgaatgtgcagaaagcaacagttacggagggaggacatcataaggaagttattaacgggcatgtattatcacatcaagcatgcaataatgtgcaaattttgcatttagttttatggcatgatttatatatggcatatttatattgtatattctggaaaaaaaaatatatatatatatttaaaggggagatactctccctgacatttctaacatatgtattaagccaaacatgagtgaatagctttcagggcgataaaactaaatatatgtctgtgtgtgtgtgtgtatgtatacacacatatacatatatatatacacatacatacacatacatacatacatacatatatatctgataaaattgtgatgttttgttcaaagttgtagttcttgtgcatgtttactttattagagtaggaaggctactggcattaattattaataccaaatattttagccttaaatttttgtcattttaaaatctgatttaatgttttctgctgtttaaggtcttgggaggctttcaattgtattttatatgagagaatcacacaagtttgtgctatctatggccctgcaaaaatataaccattacatgtttaaattgtaaattttagagcataccagtactcagtatagcattgaacatttcttatgatttttaaaagttgctagtactggggagaaataattgttgattaatttgagaattattcctttcctagactaattaaaatctggaaatctgttttgtatatgatctaatacaaagatgagctctgaacaaacactgaatcatgttaatagacagtagccaagttatattgaatatatcagaatctgtgtgaagttacacaattaattgtccctgtttcaaactgagtaaattggaaacattttctttctttttctggaaattttgtccattttaaaaaccaatcattttaagaagacatgacaatgcaatgaaacagatgataaatatttatgctt

SEQ ID NO: 68521 - DNA, 4063 bp, Homo sapiens
  misc_feature (1163)..(1163): n is a, c, g, or t
ctttgatttagtaacataaggtatagatgcatgaaaacataaacagtaaggccaggcacagtggctcacgcctgtaatcccaacactttgggaggccgaggccgggggatcacgaggtcaggagatggagaccatcctggctaacacggtgaccccccatctctactaaaagtacaaaatattagccgggcgtggtggtgggcgcctgtagtcccaggtactggggaggctgaggcagaagcatggcgtgaaccgggaggcggagcttgcagtgagccgagattgcaccactgcactccagcctgggtgacagagcaagacttcgtctaaaaaaaaaacaaaaaaaaacaaaaaaaccataaacaatataggagtgtcataggattataaatagatggcatggataataaaatctacaagtttagagaaaattcgtaattataggtgagaagtattaatgaaaggacaaagcttgttcttaaaggatcagaataggccaagatgaaaaaaggcatccatgggaaaagaactgttcatttctataattttaacaaaatagataatctatgttgaataaaatccataaatactatttccaaatttgattaaggtatttactttgaaaacctgaaacaggaacatatttacagtgttaagtgatttgataattttgtagttctgccctaaaaatcaatatccttaattaacccttcatcagtttcttaagtcatctgtcatcctgaaagcaagttaattattctaaatgttaaataattttggtagtgtctaatctataaaacatacatacactaccagtttttttctacctttaacaaattcgttcccataaaagacaattttatcactaacaaaggataactggcaggcaggtaaaggcagcttcttaggcagccagcgagttggcaggtgggttgggactcgcttgtcaactcattaattttaagcagtcagtttgggggtactgcaggataatcaggagggccgtggggagtcaagaggtgacccgggatgccggtggtggggaaagaaaagaggagcctctggaagcttggaggcaaaattgcgcttgggttcctgttccttgcatccctcctggcttgagtgcgggagaacactttttaaagactcaccttggaaagaangcctccgtcccaggggagaaggagaggcgtctgcagggggcagagaccgcagctacctgccgggtgcgccccccacccaggagcgctcgcttcgccccctttcctccccccgcccccacctccttattggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcaccacgctggtggacctcaagtggcgctggaacctcttcatcttcattctcacctacaccgtggcctggcttttcatggcgtccatgtggtgggtgatcgcctacactcggggcgacctgaacaaagcccacgtcggtaactacacgccttgcgtggccaatgtctataacttcccttctgccttcctcttcttcatcgagacggaggccaccatcggctatggctaccgatacatcacagacaagtgccccgagggcatcatcctcttcctcttccagtccatcctgggctccatcgtggacgccttcctcatcggctgcatgttcatcaagatgtcccagcccaagaagcgcgccgagaccctcatgttcagcgagcacgcggtgatctccatgagggacggcgcgcagattcgctgcaagctgctcaaaggatgacttgtcaagctcgaacatcatatactgaagatgaagttctttggggtcatcgtttttttcctgtaatttccttagaagagggattctttaaagttgattactcccagttccacgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattactggaagagaagactttcccaaaaaactcttgaggatgagttctacaacttcagaaaaagcctacagcttgggagacttgcccatgaaacttcaacgaataagttcagttccgggcaactcagaagaaaaactggtatctaaaaccaccaagatgttatctgatcccatgagccagtctgtggctgatttgccaccaaagcttcaaaagatggctggaggagcagctaggatggaagggaaccttccagccaaattaagaaaaatgaactctgatcgcttcacataacaaagcactcccttaggcattatttaatgtttgatttagtaatagtccaatatttggcgatgaggtaattctccctaaggaatctgaaagtatattttcctcccagttctacaagcatatttgagaacccttcctttcccaagtattgcgaatgtgcagaaagcaacagttacggagggaggacatcataaggaagttattaacgggcatgtattatcacatcaagcatgcaataatgtgcaaattttgcatttagttttatggcatgatttatatatggcatatttatattgtatattctggaaaaaaaaatatatatatatatttaaaggggagatactctccctgacatttctaacatatgtattaagccaaacatgagtgaatagctttcagggcgataaaactaaatatatgtctgtgtgtgtgtgtgtatgtatacacacatatacatatatatatacacatacatacacatacatacatacatacatatatatctgataaaattgtgatgttttgttcaaagttgtagttcttgtgcatgtttactttattagagtaggaaggctactggcattaattattaataccaaatattttagccttaaatttttgtcattttaaaatctgatttaatgttttctgctgtttaaggtcttgggaggctttcaattgtattttatatgagagaatcacacaagtttgtgctatctatggccctgcaaaaatataaccattacatgtttaaattgtaaattttagagcataccagtactcagtatagcattgaacatttcttatgatttttaaaagttgctagtactggggagaaataattgttgattaatttgagaattattcctttcctagactaattaaaatctggaaatctgttttgtatatgatctaatacaaagatgagctctgaacaaacactgaatcatgttaatagacagtagccaagttatattgaatatatcagaatctgtgtgaagttacacaattaattgtccctgtttcaaactgagtaaattggaaacattttctttctttttctggaaattttgtccattttaaaaaccaatcattttaagaagacatgacaatgcaatgaaacagatgataaatatttatgcttaaaatatgtatgtctaattgagtctcttttttattctgttttcttgtttatggcatttgttgtaacaggatagactttttcctcacctaggaaacctatcccatgcctgtcacttatagttcaggaggaagtttttgcacagaccagagagaaattaaaattagatgataaattgaagatatcttacacacagttttttggtgaacactgattttattggtgtcttagatccctagtctacccaaataattttaacagtactgttttttctaatcctgaagtctgatatttatgactcattagcaggaatcaaaactagtgatcag

SEQ ID NO: 68522 - DNA, 4334 bp, Homo sapiens
  misc_feature (1163)..(1163): n is a, c, g, or t
ctttgatttagtaacataaggtatagatgcatgaaaacataaacagtaaggccaggcacagtggctcacgcctgtaatcccaacactttgggaggccgaggccgggggatcacgaggtcaggagatggagaccatcctggctaacacggtgaccccccatctctactaaaagtacaaaatattagccgggcgtggtggtgggcgcctgtagtcccaggtactggggaggctgaggcagaagcatggcgtgaaccgggaggcggagcttgcagtgagccgagattgcaccactgcactccagcctgggtgacagagcaagacttcgtctaaaaaaaaaacaaaaaaaaacaaaaaaaccataaacaatataggagtgtcataggattataaatagatggcatggataataaaatctacaagtttagagaaaattcgtaattataggtgagaagtattaatgaaaggacaaagcttgttcttaaaggatcagaataggccaagatgaaaaaaggcatccatgggaaaagaactgttcatttctataattttaacaaaatagataatctatgttgaataaaatccataaatactatttccaaatttgattaaggtatttactttgaaaacctgaaacaggaacatatttacagtgttaagtgatttgataattttgtagttctgccctaaaaatcaatatccttaattaacccttcatcagtttcttaagtcatctgtcatcctgaaagcaagttaattattctaaatgttaaataattttggtagtgtctaatctataaaacatacatacactaccagtttttttctacctttaacaaattcgttcccataaaagacaattttatcactaacaaaggataactggcaggcaggtaaaggcagcttcttaggcagccagcgagttggcaggtgggttgggactcgcttgtcaactcattaattttaagcagtcagtttgggggtactgcaggataatcaggagggccgtggggagtcaagaggtgacccgggatgccggtggtggggaaagaaaagaggagcctctggaagcttggaggcaaaattgcgcttgggttcctgttccttgcatccctcctggcttgagtgcgggagaacactttttaaagactcaccttggaaagaangcctccgtcccaggggagaaggagaggcgtctgcagggggcagagaccgcagctacctgccgggtgcgccccccacccaggagcgctcgcttcgccccctttcctccccccgcccccacctccttattggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcaccacgctggtggacctcaagtggcgctggaacctcttcatcttcattctcacctacaccgtggcctggcttttcatggcgtccatgtggtgggtgatcgcctacactcggggcgacctgaacaaagcccacgtcggtaactacacgccttgcgtggccaatgtctataacttcccttctgccttcctcttcttcatcgagacggaggccaccatcggctatggctaccgatacatcacagacaagtgccccgagggcatcatcctcttcctcttccagtccatcctgggctccatcgtggacgccttcctcatcggctgcatgttcatcaagatgtcccagcccaagaagcgcgccgagaccctcatgttcagcgagcacgcggtgatctccatgagggacggaaaactcacgcttatgttccgggtgggcaacctgcgcaacagccacatggtctccgcgcagattcgctgcaagctgctcaaatctcggcagacacctgagggtgagttccttccccttgaccaacttgaactggatgtaggttttagtacaggggcagatcaactttttcttgtgtcccccctcacaatttgccacgtgatcgatgccaaaagccccttttatgacctatcccagcgaagcatgcaaactgaacagttcgagattgtcgtcatcctagaaggcattgtggaaacaactgggatgacttgtcaagctcgaacatcatatactgaagatgaagttctttggggtcatcgtttttttcctgtaatttccttagaagagggattctttaaagttgattactcccagttccacgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattactggaagagaagactttcccaaaaaactcttgaggatgagttctacaacttcagaaaaagcctacagcttgggagacttgcccatgaaacttcaacgaataagttcagttccgggcaactcagaagaaaaactggtatctaaaaccaccaagatgttatctgatcccatgagccagtctgtggctgatttgccaccaaagcttcaaaagatggctggaggagcagctaggatggaagggaaccttccagccaaattaagaaaaatgaactctgatcgcttcacataacaaagcactcccttaggcattatttaatgtttgatttagtaatagtccaatatttggcgatgaggtaattctccctaaggaatctgaaagtatattttcctcccagttctacaagcatatttgagaacccttcctttcccaagtattgcgaatgtgcagaaagcaacagttacggagggaggacatcataaggaagttattaacgggcatgtattatcacatcaagcatgcaataatgtgcaaattttgcatttagttttatggcatgatttatatatggcatatttatattgtatattctggaaaaaaaaatatatatatatatttaaaggggagatactctccctgacatttctaacatatgtattaagccaaacatgagtgaatagctttcagggcgataaaactaaatatatgtctgtgtgtgtgtgtgtatgtatacacacatatacatatatatatacacatacatacacatacatacatacatacatatatatctgataaaattgtgatgttttgttcaaagttgtagttcttgtgcatgtttactttattagagtaggaaggctactggcattaattattaataccaaatattttagccttaaatttttgtcattttaaaatctgatttaatgttttctgctgtttaaggtcttgggaggctttcaattgtattttatatgagagaatcacacaagtttgtgctatctatggccctgcaaaaatataaccattacatgtttaaattgtaaattttagagcataccagtactcagtatagcattgaacatttcttatgatttttaaaagttgctagtactggggagaaataattgttgattaatttgagaattattcctttcctagactaattaaaatctggaaatctgttttgtatatgatctaatacaaagatgagctctgaacaaacactgaatcatgttaatagacagtagccaagttatattgaatatatcagaatctgtgtgaagttacacaattaattgtccctgtttcaaactgagtaaattggaaacattttctttctttttctggaaattttgtccattttaaaaaccaatcattttaagaagacatgacaatgcaatgaaacagatgataaatatttatgcttaaaatatgtatgtctaattgagtctcttttttattctgttttcttgtttatggcatttgttgtaacaggatagactttttcctcacctaggaaacctatcccatgcctgtcacttatagttcaggaggaagtttttgcacagaccagagagaaattaaaattagatgataaattgaagatatcttacacacagttttttggtgaacactgattttattggtgtcttagatccctagtctacccaaataattttaacagtactgttttttctaatcctgaagtctgatatttatgactcattagcaggaatcaaaactagtgatcag

SEQ ID NO: 68523 - DNA, 490 bp, Homo sapiens
tctagtctggcctttttccctgtataggttttatactcaggcttgatcccatcatggctgcgagatggcagtaacaatgctaggcataatatccaaaattaatttacaggtacaggaaagggggcatctctttcgtgtgtctcttttaagagtaagaaaattcttgtagaagtttctctgcattccttcatatactgttggccagaattacatcacatgctgagttgtgaagcagtcattaatgagggtgagagcacatgattgattcagacttatcaagatctgccggggctggctgcataattcccagggcccagtgcaaaatgaaaactcagggcccaaggtaggggtggggaagttaatcttcctttgtcatgggcccaccatctcaacccacagtggaggacaacccaagggattgctgcctgtgtgccaggatgcacagaggcacctagatgatggatgggcaagaggctaccactggtttgcc

SEQ ID NO: 68524 - DNA, 862 bp, Homo sapiens
gtaaggtagttaaattagaaatatgtttgatctccattttacactttttgatgaagttcttgccttcagctttggagtctgttggaatgaaactgtgtctcacagcttgcatctgatgtagcagattgccctgttcaagtcagcatgaacaaagctcgcagaaaggctactaggtaacggatttgagtttattcagtagaaaaaaagggaatgaggacatatctttaggtcccagaagcagcaaaacctcctagttacataacagcagggaaactaggagatgaaatctccaaaattttgtccagtctgtatgaactgcagtgattgtctgtctgctagacacttttttttagcctaattcttgttcgtttcattaccttcatatgtgtgcattgtactggttttgaaatgagcagacattgagaaaacaattttctgattccccattaggaacatatgattttcatttccctttagtgcaaaggaacaaacatcacattgaggagggagaagtgtacccttctttttcagcttaatgttacctctctttaaaaaaaaaacatttttgaaaaatttcttgactgatgacattctagaatttattgattcaatttaaaattccctgcatagtccaaataaacataatttttactcttcaagtcatctaaagagttgtgagaaagagcagtactatgtgttttatccttagagcattatccttctaagtgaactcctttcttattactgagcgtgtgtgtgtgtgtgtgtgtgtgtgtgtgtgtaggataaaattgtaatggccttaaagttgttacctggcatttttggtttcttaaaataggcatccccctactccctttac

SEQ ID NO: 68525 - DNA, 662 bp, Homo sapiens
gaagggttagccgtcactttaacacagtcctcatcaacatcgcaacaaaattaaaggaatgcaaggaaaacctattctgaaagaatgggcacagataatagctagagaaattctgaaaaaatgaatgcaggtgtttaactgtgttttttaactataataaaatgatctggcactggtgctggaatagaccgatcaagggaacagtacggatagtccgttaataaagccacagagatatgctaaggatagcgttttaaactggtgggaaaagactgaagtgttgaataagagttattgataattggccaaccatttggaaagaaaataattatcttgatgcatacacataaaattagaaatttctgtctggcagaaaacatcataaaattagaaaaatattcctgtaatctcagcactttgggaggccaaggcaggtggatcacgaggtcaggagatccaagaccatcctggctaacacggtgaaaccccgtctctactaaaaatacaaaaaattagccgggcgcagtggcggccacctgtagtcccagctactcaggaggctgaggcaggagaatggcatgaacccgggaggcagagcttgcagtgagctgagattgcaccactgcactccagcctgggcgacagagtgagaccccgtctgt

SEQ ID NO: 68526 - DNA, 567 bp, Homo sapiens
tttggtattttttgtagaaatggggttttgccatgttgcccaggctggtcttgaactcctcggctcaagcaatttgcccgactcagcctctcccaaagtgctaagattacagatgtgagctactgcaccgcacctgccttagacaggttttgtgagcacatccaagctcagtaagaagagacatagttggtggggggcagggtggcacagtcagtcatgaggataagatgagtcagagggagcactgcatatttgccaggcctgcccatgttcctaggtgagtcccacaggtaagctgataagctgacatgatggggaaacagtgccgtcatgacccagccaagtcttggagaggtgaatgaatggaggtctgggtacagaaggggtacagcgacagtatgtgcagaagccacagctttgcctgttttcttccccacaaccagaatttgttttcaactgtagaaaggacggtactggtccagctcacaaagcactcagtgagttgcagatgcaaatgcactattcagtatcatatatgaaacagggaagactgagggaggtggacat

SEQ ID NO: 68527 - DNA, 347 bp, Homo sapiens
cagagcttggtcactttgcactttgttcagcacgtgccttttggttctttgctgtgcgagcacagagctgctggaggggtgagggagaagggtagtcctcactcccttaggagatgagtcgggtcccatcttgtcgcagagcttttgtacttcctttacctcccttcctactgtaagctccttgtgggctggacttggcatggagcatctttgaatttcccccaggcaccaaaaaaggccttcaatcataacaatcgaaacaacagtaataacgctggaggtgtccgagaccgttgacagcactttacatgaaccaactcattctgtcatcacaagtttcccatgaa

SEQ ID NO: 68528 - DNA, 327 bp, Homo sapiens
caaactaaatattaaaaattatatttttgtaccacaatgataagaaattatgtgaagatttaaaatgtttaaagtattctaattatagttttgaattgcctgttttgagtgtcagtcagattaactacagaggtcagccacatatcatctctatagtttcttgtattaatattttgcctaatccatcctctatttctcatcacctttcgacagtatgatctttgaagtctttttaagttaatgtatatataccagatttcacttgctcttgccttgattaaacattctgttgattggtgaaaacccttgactgttttccagattttt

SEQ ID NO: 68529 - DNA, 375 bp, Homo sapiens
tgtgggggcacacagtggagctccccgatgtgttctggggagaagaaagagggtctgggactagaaaataggtgagtcttaattctaaattccttgtgcttggcacatattaacaaccattgaactttggtgaatatatgactgaggagcttactgactgaagatgtaaataaaaatatattttcattggaaatcaggtacataagtatctattttggaatggaagggaggttacgatatacattttaagtttcctagaagaaagaaggagtgaagtaaagtgccacatgatcttttcttctttcattccttaaattttttttttgagacggagtctcgctttgttgcccacgctggagtgcagtggtgtgatct

SEQ ID NO: 68530 - DNA, 352 bp, Homo sapiens
ccttttttgctgctgtctcatactccatggtacagtgttccacagtttctttaattattcagccatgggaagaaacggggtgtttccagttttgtgactctcgtgagtaacattctggtgcacatttgtggacagtttgtgtgtgaacattagttttcatttctctggctcaaattcaactgctgggtcatatggtacttagaaaattattaccatttccccaggcctttcctggaaaaaaattatttaagataaatattctgtagagacaggcagcaaaggtggacaacattttctctttttttcattgtttcatttttagttgtaagtgtatgtttttggtagggaaatc

SEQ ID NO: 68531 - DNA, 293 bp, Homo sapiens
aaggtcaagaggcagggagatgagaaacaagtcagcaggcagattgatggagacaaataatttggggtctaggttaggaaataggtttaggttttgtagccccagctgaaaggtacagaccagaaaagccatctcggctgcttagggaagttctgttctcatgcttttgtttatacaggccatagctttctccttcaggactcaaacgacaaccccctgcagaagtgcctgatggaaaaataggttcttagcaagaggagaggctgggatgctccgggcacagggttctgacc

SEQ ID NO: 68532 - DNA, 346 bp, Homo sapiens
tacttgtgatgctcaaggaataaattttagttttctgaaaaagtcacctatgcagagttcctcaggccccaaagctgccagataaatcacagtcagggctggaagggactgtgtctccattttacagaggaaaccaaaactcagagaggttaagccacttccatgagctcacacaataagtgtcaatgggggatttgaatccatgcctttttgattccggatgtggtaacatggagatgcgccacccagatcccccttcaaggatggtgatagtgtttttcctgttcagtttgacacttccagaccgccctgtacataaatcccaataaatgctatgcctccttca

SEQ ID NO: 68533 - DNA, 977 bp, Homo sapiens
accgaaccccgcccgcgccgggagcatctcgcgtccccaacgggcccccgggtcggtttccgcggtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattca

SEQ ID NO: 68534 - DNA, 1230 bp, Homo sapiens
ctgtaataagtctcatggtggctggaatgttcttttctaccctttgactttgagctcagtcatgtggcttgaattggccaattagtggttatgatgtaagttagaggcttaaaaagtatttgcatgattggaccttccttcttggactctggtgccatgagaagaagataccttgggaagttaatggccacttagcctggacccttgaatgaatatacccagagccacacagagcccaccccaggagcttgcagcagagttttccagctgatcccagcctttatcagcaatgcacagtcagcctttagacctctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattcaaaaaaaaaaaaacaacaaaaaaaaagggggggggggcgccaaaaaaatatcccccggggggggcaccccatttgggtggcccccctttttttgtgaaaaaggggggcccccaaaagggggggccataaataaaaagcgagggcgcgggggcagcggcgataaaaaacaaccgcgtggcgaggggaaaaaacagcggagtcacgggggaggaagcctcacttgggaggagaacgaggaccccacacaacggtgggggggggggcgaacaacatagtggggaggaccaaaaccaccactacccacgacaagaagattttataacacgccacaggaggaggacaaatacaaacctcagaggaggggtgattcatgcgcggtggcacacccaacgccgggcatcattattgccggtcgcgcggatgaaaaaagtcgtgcgcaaccacggggagaatttcatatggaccacaacattattatcagccgaggagg

SEQ ID NO: 68535 - DNA, 456 bp, Homo sapiens
agtcctgctaattccctgaatcaggccactgccatctcatgcctgcgttgcactgaggacctccagtctggaagctcattttccatatctttacaaagcagatctatcactctgaactgttgtctcgacccgagttttgataggtattgtgctgggatctgaccattcaaaatacaatcactggaatctgaagaagtattctgtgggagtgaatggaaatatatatgacttttaaatgggcaaagatattagtgaacttctaggtgctgaggaaacaacaaagagcaaagcaaagtccctgtcccccaggagttcgcgttttaacggggaagaaaaataagcaagtgaaatggacgactgtgagaagacggagcagggagatgttactattgcttgtagggtggtcacagaatgcctgcaaaaacaacccttttgaagaattgggaaaaaaataaa

SEQ ID NO: 68536 - DNA, 415 bp, Homo sapiens
cccttttctcccctttttcattactctgctgcattctgccattcatttcctttcctcttcccgcttccctctctgattcatcatttagccaagcacatgcctctccagagccagctgtccactgcttcaggaagaacataagcaccctttcccctccaacacactttgtattaactagtccttggaaatttgacttgaaatcttggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattca

SEQ ID NO: 68537 - DNA, 515 bp, Homo sapiens
cccttttctcccctttttcattactctgctgcattctgccattcatttcctttcctcttcccgcttccctctctgattcatcatttagccaagcacatgcctctccagagccagctgtccactgcttcaggaagaacataagcaccctttcccctccaacacactttgtattaactagtccttggaaatttgacttgaaatcttggcaggaaaagagttaacagtgtttttcttcctgtttagtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccaggtgagtgttgccgccatgctc

SEQ ID NO: 68538 - DNA, 1503 bp, Homo sapiens
accgaaccccgcccgcgccgggagcatctcgcgtccccaacgggcccccgggtcggtttccgcggtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattcaaaaaaaaaaaaaaaaaaaaaaaaaaaaaaaaaaaaaaaaaaaaaaaaaacaacaaaaaaaaagggggggggggcgccaaaaaaatatcccccggggggggcaccccatttgggtggcccccctttttttgtgaaaaaggggggcccccaaaagggggggccataaataaaaagcgagggcgcgggggcagcggcgataaaaaacaaccgcgtggcgaggggaaaaaacagcggagtcacgggggaggaagcctcacttgggaggagaacgaggaccccacacaacggtgggggggggggcgaacaacatagtggggaggaccaaaaccaccactacccacgacaagaagattttataacacgccacaggaggaggacaaatacaaacctcagaggaggggtgattcatgcgcggtggcacacccaacgccgggcatcattattgccggtcgcgcggatgaaaaaagtcgtgcgcaaccacggggagaatttcatatggaccacaacattattatcagccgaggagg

SEQ ID NO: 68539 - DNA, 1466 bp, Homo sapiens
accgaaccccgcccgcgccgggagcatctcgcgtccccaacgggcccccgggtcggtttccgcggtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattcaaaaaaaaaaaaacaacaaaaaaaaagggggggggggcgccaaaaaaatatcccccggggggggcaccccatttgggtggcccccctttttttgtgaaaaaggggggcccccaaaagggggggccataaataaaaagcgagggcgcgggggcagcggcgataaaaaacaaccgcgtggcgaggggaaaaaacagcggagtcacgggggaggaagcctcacttgggaggagaacgaggaccccacacaacggtgggggggggggcgaacaacatagtggggaggaccaaaaccaccactacccacgacaagaagattttataacacgccacaggaggaggacaaatacaaacctcagaggaggggtgattcatgcgcggtggcacacccaacgccgggcatcattattgccggtcgcgcggatgaaaaaagtcgtgcgcaaccacggggagaatttcatatggaccacaacattattatcagccgaggagg

SEQ ID NO: 68540 - DNA, 854 bp, Homo sapiens
accgaaccccgcccgcgccgggagcatctcgcgtccccaacgggcccccgggtcggtttccgcggtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattca

SEQ ID NO: 68541 - DNA, 937 bp, Homo sapiens
agtcctgctaattccctgaatcaggccactgccatctcatgcctgcgttgcactgaggacctccagtctggaagctcattttccatatctttacaaagcagatctatcactctgaactgttgtctcgacccgagttttgatagagctttcttctggttggtgtctctactgatttcgtcccttgtttggttcatggcaagagtcattattgacaacaaagatggaccaacacagaaatatctgctgatctttggagcgtttgtctctgtctatatccaagaaatgttccgatttgcatattataaactcttaaaaaaagccagtgaaggtttgaagagtataaacccaggtgagacagcaccctctatgcgactgctggcctatgtttctggcttgggctttggaatcatgagtggagtattttcctttgtgaataccctatctgactccttggggccaggcacagtgggcattcatggagattctcctcaattcttcctttattcagctttcatgacgctggtcattatcttgctgcatgtattctggggcattgtattttttgatggctgtgagaagaaaaagtggggcatcctccttatcgttctcctgacccacctgctggtgtcagcccagaccttcataagttcttattatggaataaacctggcgtcagcatttataatcctggtgctcatgggcacctgggcattcttagctgcgggaggcagctgccgaagcctgaaactctgcctgctctgccaagacaagaactttcttctttacaaccagcgctccagataacctcagggaaccagcacttcccaaaccgcagactacatctttagaggaagcacaactgtgcctttttctgaaaatccctttttctggtggaattgagaaagaaataaaactatgcagatatgcgttccattca

SEQ ID NO: 68542 - DNA, 767 bp, Homo sapiens
gggacccagagccgccgcgggagctcacagcgtccccaggttttataataatcaagaagcacatgaaagaggcctcttcatcaagcattcttgactaagttatgaaaatggaattgaagtttattttcccccttcatatggagtgtctcatttggtattcattccacacaaatgccactgtttcttcaggtgccatgtaacttcagagaaaggcatgagagaagccgggccttcagcaaggatatgggactggctaagaattaagaagaaagaagcctcactttagaactaatggggtcttgtatgtatagcttattcccccactggatagatatggatacttaaacattgagaaatctttattctctacttgaatagttgagaacaaacgatacactcacgaggaggctaaccttacccatgttgtccatatatttaaatgaaattttataataactccatctgttgaaatgggctgtgtgtttttccgcatgactttcccattttatctcatcaacctgaccttgctggcacaaggtacaatcactgtagtatcctgcttgtttcatcaggaagtggagcaatagtttaatttgttaaggaaatcccaaggaatgaactaaagcttgcgttgtgtgttttcccacaaattgtgttttctttgaatttgtggttgtgagggcatatcgctcatcgacacctgatccacaagtattggctgtttgtcaaggaccccgagaatcctgaagttgtcacgtcatagagat

SEQ ID NO: 68543 - DNA, 4511 bp, Homo sapiens
ggctgtacggccgagattatgtatccgccgtggagccgggtgtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 68544 - DNA, 4393 bp, Homo sapiens
ggctgtacggccgagattatgtatccgccgtggagccgggtgtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 68545 - DNA, 4264 bp, Homo sapiens
gctggacgtgccacactggggtcttctgaaagtaggcgcagcatctgcagctcctcatgcccggccctaaggttttataataatcaagaagcacatgaaagaggcctcttcatcaagcattcttgactaagttatgaaaatggaattgaagtttattttcccccttcatatggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 68546 - DNA, 4653 bp, Homo sapiens
ggctgtacggccgagattatgtatccgccgtggagccgggtgtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcaggtgagactgtgtgaggcccccattcatccagctctcctcacctctcatggaagcttttatcttctatgtccctggaaaggaacatggtcagcaggcagctcatggatgattcctcgagactggctggtggtcacatattaatacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 68547 - DNA, 4457 bp, Homo sapiens
ggctgtacggccgagattatgtatccgccgtggagccgggtgtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 68548 - DNA, 5034 bp, Homo sapiens
ggctgtacggccgagattatgtatccgccgtggagccgggtgtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaaaaaaaaaaaaaaaaaacacaacaaaacaacaaaaaccaaaaaacaagaaaaaaaaaaagaacaacaagaaaaaaaagggaggaggggcggcacatcaagagccccacaagaggagacacgagcatgcgaacgcacacaccgactttatggacacacaaggtcgcccccataggaaggcccagcatatcaaacgcactacgacgcagcgaccgcgatagaaaaaagacaaagcacaggcagagaccaaacgtgcagaagacagagaaacatgaaggaaacagaagacaaccacaaccagtggggggaggacacaaacacaccagtcgggcaaaacaaaaccccccacgacgaagatgcacgcagaacgcaccgcgaagaagaggacgacataaaacactaccccagacgacgacgcaccggggggcacagcaaaaacacgcagacaataaacggcggagcaaaaagaaaaaagtgatgacagcgaagacgagacgaaagcgacgcacacaaaaactatacaagg

SEQ ID NO: 68549 - DNA, 2531 bp, Homo sapiens
ggctgtacggccgagattatgtatccgccgtggagccgggtgtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcaggtgagactgtgtgaggcccccattcatccagctctcctcacctctcatggaagcttttatcttctatgtccctggaaaggaacatggtcagcaggcagctcatggatgattcctcgagactggctggtggtcacatattaatgtgagatgacataaggaattgaaggctgggaattgtctttggagaacttgatgatgaggggagttgggtgggctagagtccagggtgccctg

SEQ ID NO: 68550 - DNA, 2058 bp, Homo sapiens
ggctgtacggccgagattatgtatccgccgtggagccgggtgtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcgggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagatttgttcagttgggaagctgaagcaggtctgcataggatatatgaacttaaatgcctttctctggaattcagat

SEQ ID NO: 68551 - DNA, 718 bp, Homo sapiens
gggacccagagccgccgcgggagctcacagcgtccccaggttttataataatcaagaagcacatgaaagaggcctcttcatcaagcattcttgactaagttatgaaaatggaattgaagtttattttcccccttcatatggtgccatgtaacttcagagaaaggcatgagagaagccgggccttcagcaaggatatgggactggctaagaattaagaagaaagaagcctcactttagaactaatggggtcttgtatgtatagcttattcccccactggatagatatggatacttaaacattgagaaatctttattctctacttgaatagttgagaacaaacgatacactcacgaggaggctaaccttacccatgttgtccatatatttaaatgaaattttataataactccatctgttgaaatgggctgtgtgtttttccgcatgactttcccattttatctcatcaacctgaccttgctggcacaaggtacaatcactgtagtatcctgcttgtttcatcaggaagtggagcaatagtttaatttgttaaggaaatcccaaggaatgaactaaagcttgcgttgtgtgttttcccacaaattgtgttttctttgaatttgtggttgtgagggcatatcgctcatcgacacctgatccacaagtattggctgtttgtcaaggaccccgagaatcctgaagttgtcacgtcatagagat

SEQ ID NO: 68552 - DNA, 451 bp, Homo sapiens
aagcgtcccccagcacacacacacacacacacgcgtgcgcgcgcgcgcactcacacacacacacacactggcggaggcgggggtggccagagggattagagagataaagtcactgtcagtcagaaaagataagaatctgggctggacgtgccacactggggtcttctgaaagtaggcgcagcatctgcagctcctcatgcccggccctaaggtgatgcgggattgatttttcttggtttgttagccgtgaaagccccgggctgtaaaaaggtttgggtcaagaactagactttgatttattgaggcttgctttgccctgctatgccacaccttgtggtgtctggagatggggtattttggagcactcatacaaagtttgaactggtattcaagtgagcttgaatactcacttgatttttaacacttgggaattaaaaaaaaatgaagatat

SEQ ID NO: 68553 - DNA, 4583 bp, Homo sapiens
ggctgtacggccgagattatgtatccgccgtggagccgggtgtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagaactcttctatccataggccaacctatgttgcagttgattaaggggtgcagctcccatataaatgctggcagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 68554 - DNA, 4142 bp, Homo sapiens
ggctgtacggccgagattatgtatccgccgtggagccgggtgtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 68555 - DNA, 2853 bp, Homo sapiens
tcgagccggaccggtgttatcgatgcaccatcgtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattgtgagttcgttctgactctttctcattctgagttttcagtgttaaactaggaagtgtgacagcaggggagctttcgtgaggcagtcagtcattgcttctctgtaaattaaaatgttacagcacacacatacacacacagagagcatttcaaggccacagctccacacctgccatgggatgttaatgtggcagggggtggggctcattctgttgggaggtcaaattaccaatgccaaggactgttgattttgtttttatttttattttttcttctagcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 68556 - DNA, 4235 bp, Homo sapiens
ggctgtacggccgagattatgtatccgccgtggagccgggtgtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggagccatcagtgcccacaagccgctgctgatctgtagctgtgagtggatggcagccatgttcggggggtcatttgtggaaagtgccaacagtgaggtgtatctcccgaacataaacaagatatcaatgcaagcagtattggattatctctataccaagcagttgtctcctaacttggatctggacccgctggaattaattgccttggcaaacagattttgcctgccacacttggttgcacttgcagaacagcatgccgttcaggagttgaccaaagccgccacgagtggcgtgggcattgacggagaagtgctctcttacttggaattggctcagtttcacaatgcccaccagttggccgcctggtgtttgcaccacatctgcaccaactacaacagtgtatgctccaagttccgtaaggaaatcaaatcaaaatctgcagacaaccaggaatacttcgagcggcaccgctggccccctgtgtggtacctgaaggaagaagatcactaccagcgtgtgaaaagggaacgagagaaggaagatattgcactaaataagcatcgctcaagacgaaagtggtgcttctggaattcatctccagcagtggcctgaagaggaagagaaaaaaaacaaaaaacagaaaccaatcggtaatctgatccaccacttttcaaagcactactataaaattcgtcttgttagagatacgacatagttcaggtttcgggcactgatcttcctccacttttgtgcatttatctttgttaggatcaaagcacaagctcaccatcaatgagcctggacaaaaagggaagctgactctcactgcattccttaaactgatatgtatattttttttgttaggaggcttaataaactttagtctgttattttgtttctttttatacaaagaaaaaaaattcagctttcatgtttctgattccagattggaaaatatttttatatggtctgttgtattttgttgaaatgaaaatactgtgtattactttattttacaggccacaattgattatgaagtcaccctgtgattctctttgcccacatgaccaccgagcattattacgtaattagagggttatccttttgttgtgaaaggaaggaggggactgaaatctcccaaagtgcaaattggagagtgtttaatctttgttctgttgaataacatcggtgtaattacaaagtcaactccaagaatgtgtatttacaatatttgccatgttaagtgctggtaattatatggttatatgtgccatgtaaaatatagtgatatcaaatattctgttgtttccaatgtctagtttcaagaggacaatctttataatcattagaagggcttattaaatcccagcattatccagggcaaactcactggtggacctgaatacataagataccattagtgcgctggtgttcggattgctgtattagggtttacatctctcagtattccttgaacttgccatgcttctgcatgcagattcttcactgacttgaattgagatgggcaagggaaaaggtccctggactccctcctgccatctacaggcttgtcacatctcaccaccagaaacaggcttcctcaggcttctcacctgtggccaacttcactttgtaagacccatatttttaactcttcccagggaaaattcatgttgctgcagaagtaggctaaggcagaccacccacttctgctgaaatgcattgggagcctgtgaaagcacaaagctggaggctgggcgcctgcgttctcctacacggaaaggaatctaattccaagagtctaggaaatggtgctattcttttcagaagatggaaatgagacagttgagtccaaaccccaatgctgacagccatatgcatttgaaaatctatctagattacagatgggcatttattactggcagtggaaacaccagatagaagatcttaggagaggcccagaaatgcatcaccttgtcatgacaaaagagaaggcagtagagtagggatagttacaaatgcatccatcttaattattttcaataggcttgtaaatcttatcgatggaaggagaaaggagacaagatgtggaagaattgacatgtatcccaccataaaatggtagaagatgagttttcaatgagtagtcatagttgaaattttacaaccaaagctcccatttgattgtaatcttgccaaaatataatggatgtataaatgaacttggggtataagcaataatatccactagtgttgttatcagctactgtaaccaagtggctggttcatttggttgatgctgattatggcctttaaccatggtggtttgttgtgtgttttttatttcacaaaaagccaataaaattgtttagctataaaa

SEQ ID NO: 68557 - DNA, 1910 bp, Homo sapiens
ggctgtacggccgagattatgtatccgccgtggagccgggtgtgggggcaggcgaaggggagggctgcgggtggaaaggggcgagcccctctcgcccgggactgggaagagcggccacggcgccgggcgaggcggcagggcgaggcagtgccatgctgcctttgtgcaaagttgggcggcgggcggcgcgccgcgcgcaggggccccgcacacccgcgaccgcgcgcagccgtggctgctgctgagtggcgggggcccccccgctccccccggcccttgaaggcggagagagctcgcgtctcgctcggcttcagggtaagtccagctgtgagcagagtgttctgttcttcacttccagcaagccagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtcttggagcgttctcgggatgttgttgatgaagtgagtgtttctctcaggctttgggatacttttggtgatcatcacaaagacagacgctttgcatatggcaggtctgatgttgtggtcctctgtttttcgattgctaatcccaattccctaaatcatgtgaaaagcatgtggtatccagaaatcaagcacttttgccctcgaacacccgttatccttgttgggtgccagcttgatctccgctatgccgacctggaagctgttaatcgagccaggcgcccgttagcaaggcccataaagagaggggatattttgcccccagaaaaaggccgagaggtagcaaaggaacttggcttaccatactatgaaacaagcgtgtttgaccagtttggtatcaaggatgtgtttgacaatgcaatccgagcagcgctgatttcccgcaggcacctgcaattctggaaatcccacctaaagaaagtccagaaacctttacttcaggcacccttcctacctccaaaagcccctccaccggtcatcaaaattccagagtgtccttccatggggacaaatgaagctgcctgtttactggacaatcctctatgtgccgatgttctgttcatccttcaggaccaggaacacatctttgcacatcgaatttacctcgctacctcttcttccaaattttatgatctgtttttaatggaatgtgaagaatccccaaatgggagtgaaggagcctgtgagaaagagaagcagagcagagatttccaggggcggatattgagtgtcgacccagaggaagaaagggaggagggcccgcctaggattcctcaggccgaccagtggaagtcttcaaacaagagcctggtggaggctctggggctggaagccgagggtgcagttcctgagacacagactttgaccggatggagtaaggggttcattggcatgcacagggaaatgcaagtcaaccccatttcaaagcggatggggcccatgactgtggtcaggatggacgcttcagtccagccaggcccttttcggaccctgctccagtttctttatacgggacaactggatgaaaaggaaaaggatttggtgggcctggctcagatcgcagaggtcctcgagatgttcgatttgaggatgatggtggaaaacatcatgaacaaggaagccttcatgaaccaggagattacgaaagcctttcacgtaaggaaagccaatcggataaaagagtgtctcagcaagggaacgttctcggacgtgacatttaaattggacgatggacatctgagcccactgacgctgctggtatgctgttcaaaatccttggtgttct

SEQ ID NO: 68558 - DNA, 1178 bp, Homo sapiens
aaatgagactgtgatcgaaatctcccctctttggaatcctgcccttcagataagaagcaatgtgaattaagtgcttcctgggggccgggccccagcacttcacattcactcgattcacagcctccccgtataccgtctccccattttacaggggacaagcaagcagactcccagagaagcctgtgttcctaaccgctgcacctcctgctccttcagcaggatggggtcaccaggttacactccgaggcgtcagttccatccacgtgctcagcagggacgggaagcagctcacacccacttcttgttttccttcccaacatggtcttcttggtcccccaaaatgagcacttcagcctctataacttgagtgtattggcttttggaaattgtgaagatttttctgtatgaagcagccccaggtgaaccagaggctgccttttctggagctgctgaaatccaagggctattttcaagtcggtcagaacctgccctgtaccccccacccaaccctgccgaaatgtcaaggccagaagctgtggcgttggtgcgggtaccacctccttcactctgagcgtgtggccccacaggtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtaggcctcttttctttccttcttctgtagggttttatctcttccacgatagaaataaacacagcattttaaaactggcaaagccccgagagccgttctgtgtggtaacagatagcaggattcagtttgggccactcattgaaatgtgagtttgtcttatcttttttttttgagacggaatctcattctgtcgcccaggctagagtgtggtgacacgatctcggctcactgcaacctccgcctcccaggttcaggcgattctcctgcctcagcctcccgtgtagccgggattatagcacccgccaccacgctcggctaaagcttgttttctttattagcatttatgctgactgagaatccatacatgcacattatttttaaaaattagaagcagggtatgaggttagaaagtgaagggctcttatcagtcaccatgcacagaa

SEQ ID NO: 68559 - DNA, 2353 bp, Homo sapiens
ttatggctaggtacgaggctgggtgttaatgcggccgagggtgagctgtcgcgggcggcgcccggccttgctcaacgcccagcagtccccaccgtcgctgccgccgccaccgccctcggccgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactc

SEQ ID NO: 68560 - DNA, 2371 bp, Homo sapiens
aaatgagactgtgatcgaaatctcccctctttggaatcctgcccttcagataagaagcaatgtgaattaagtgcttcctgggggccgggccccagcacttcacattcactcgattcacagcctccccgtataccgtctccccattttacaggggacaagcaagcagactcccagagaagcctgtgttcctaaccgctgcacctcctgctccttcagcaggatggggtcaccaggttacactccgaggcgtcagttccatccacgtgctcagcagggacgggaagcagctcacacccacttcttgttttccttcccaacatggtcttcttggtcccccaaaatgagcacttcagcctctataacttgagtgtattggcttttggaaattgtgaagatttttctgtatgaagcagccccaggtgaaccagaggctgccttttctggagctgctgaaatccaagggctattttcaagtcggtcagaacctgccctgtaccccccacccaaccctgccgaaatgtcaaggccagaagctgtggcgttggtgcgggtaccacctccttcactctgagcgtgtggccccacaggtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactc

SEQ ID NO: 68561 - DNA, 1452 bp, Homo sapiens
acgcgcttgaactggcttttggccttgatcatgtctcgatgcggctgtgggagtgcttctcgatcaccgactcgatccatatcaaaggcttgagcgtgggtgttgagacggtaggacatgagctcgaactcgccgtcgggtgggatgaaggagatggtgcggtcattctcgaaacgtgattgtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactc

SEQ ID NO: 68562 - DNA, 1341 bp, Homo sapiens
ggcctgcaaatcagaagttacaattgacttcacacggggctcacagatatggccaatggtttcacaacgcatcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactc

SEQ ID NO: 68563 - DNA, 1034 bp, Homo sapiens
tagctgtccatttttctctcatctggtcgctacctgaatgatcagtgatcgagtggagtccaggtgctgcctgggtgcgttatatcacgcgtcaatgtgagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactc

SEQ ID NO: 68564 - DNA, 499 bp, Homo sapiens
ttatggctaggtacgaggctgggtgttaatgcggccgagggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgagtctcgctcggaggggccgtgggcttgggtggaggttgtcttggctctgcttgtggacctccccatacctggccaccctaca

SEQ ID NO: 68565 - DNA, 2344 bp, Homo sapiens
aggctggtacggtcacggtgtatggatccgcgcggctccccgaaccggaagtggaggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactc

SEQ ID NO: 68566 - DNA, 2328 bp, Homo sapiens
ttatggctaggtacgaggctgggtgttaatgcggccgagggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactc

SEQ ID NO: 68567 - DNA, 2753 bp, Homo sapiens
aggctggtacggtcacggtgtatggatccgcgcggctccccgaaccggaagtggaggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactcaaaaaaaaaaaaaaaaaaaaaaaaaaaaaaaaaaaaaaaagaaaaaaacaaaaaaaaaaaaaaaaaaaaaaacaaaaaagaggggggggcgcgcgcccatgaaaatacccccgagcgagggggcgcccacaaatgcggcgagcgccccacgtttttgttggaaagaggaggggcgcccctatagagagggggtctaattatataaagagacgagaagagcggaggggcgtgtgtatacacacagagtgcgtgaggggcggaacaccaggcgagccaggggcgacacatgtgggagagaggcacaccaaaagaggggggggggggacacaaaggcgggggaacacacaccacacgaagaagatataaccgcccccacggggaacacaaaccaaaagtggaggggagaata

SEQ ID NO: 68568 - DNA, 1464 bp, Homo sapiens
ataggctaggagaggccggtgtaatcgacagagggcacatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccagcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactc

SEQ ID NO: 68569 - DNA, 1526 bp, Homo sapiens
aggctggtacggtcacggtgtatggatccgcgcggctccccgaaccggaagtggaggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccagactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactc

SEQ ID NO: 68570 - DNA, 1151 bp, Homo sapiens
aggctggtacggtcacggtgtatggatccgcgcggctccccgaaccggaagtggaggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttggtaggcctcttttctttccttcttctgtagggttttatctcttccacgatagaaataaacacagcattttaaaactggcaaagccccgagagccgttctgtgtggtaacagatagcaggattcagtttgggccactcattgaaatgtgagtttgtcttatcttttttttttgagacggaatctcattctgtcgcccaggctagagtgtggtgacacgatctcggctcactgcaacctccgcctcccaggttcaggcgattctcctgcctcagcctcccgtgtagccgggattatagcacccgccaccacgctcggctaaagcttgttttctttattagcatttatgctgactgagaatccatacatgcacattatttttaaaaattagaagcagggtatgaggttagaaagtgaagggctcttatcagtcaccatgcacagaa

SEQ ID NO: 68571 - DNA, 622 bp, Homo sapiens
attgtagaactgaaaatgcaagcatcttttctcttccttccccaccccaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatcgtatccctttgctgggggtgctcccaggggactcctgtgtgggtgttggtgtgtgtgcatatccacacgcctgcaagcagggctggtttgtgcacagcgcaagcattggacacagccatgccctcctggagctccctgctgcctgcggagacaggcagacaatgcacgatgacatgtgtgatgggtgtggggagaggagcaggtgtgacttgaacctcttcagcccaggggcccaggaagggaaatgacaccctggaggaagcctgcagggaggcctggcttctgccagctggaggggtgggcaggcactaggcgtgggtgaaggctctgcagggaagagcctcattccaacagctgcactcggggtggctggagagggggcgtgtagggcagcgaggctggagtggtcagcggg

SEQ ID NO: 68572 - DNA, 406 bp, Homo sapiens
gagaaatacctaatgtgaatgacgagttgatgggtgcagcacaccaacatggcacatgtatacctatgtaacaaacctgcacattgtgacatgtactctagaacttaaagtataataataaaaaaagagaacctttaaaaaaaaatagactgccagatagactaataaataaaaaagagaggttgaaataatcataaatgactaaggggatgttaccccacagaactacaaaaaacaaacaaaaaaacctcagagactactaaaacactcctatgcacacaaactagaaaacctagaagaaatgggtaaatttctggaaacatacaaccaccgaagattgaaccaggaagagattaaagccctgaacagactaataatgagtttcaaaattgaatcagtaataaaa

SEQ ID NO: 68573 - DNA, 1904 bp, Homo sapiens
aaaattagtgcggtgtggtggcacgcacctgtagtcccagctactcgggaggctgaagcgggagggtcccctaagtctaggaggtcgaggcttcagtgagcggtgattgtgccactgcactccagcctgggcgacagagcaagaccctgctttcccctcttgtcctccactaccctcaggaaaccaagaaagaccagcgtggagagttggtcgcccatctgctctaagctgctgtgtattcccctgtaatgtaaacatcgtgaaggtggagacccagttaaccttttaggtggaaggccagatgacagagggcggcatctgacccggaaggccctctgcaaccaggccaaatacatctacagggaaccaatgggaaacatctggggaggacaacccaaataagtatcatgcgagcaagggatggtttgagaactttaaaaatcgctgctgttttgcaacatacgaagttgatggggaggaaggacccttaaatcctgagtgggtatcgagtattccaagcaactggagagaggctttgtgcctcaacaggtcttcaacgccaaggagatgacccatcttttgcagtgcatgccttcctacttttggggcaaaagacaaaaatctggaaagcttagaggaagctaaggacaggatttccctcatttttttgtggcagtgcctcaggtgacaaaatgataaaaccactgctgctttacaaagactctaacaccccacttgtcttttagagataaacgccttcctgttttcttgtaatcacacccagaatcaccactgccactttttggattagttttacaatttttttatccatcaaatccgaagtcatttaacaaaaaaaatctggaaatcagaatgttgctaactgtggacagaggtcccaatcacccagattcattattctttgttcattctaatgttgatactgtgtttctccctcaggaaggccctagctttcttcagcccttgggtcagggtataactgaagcatttgaacataatcaagcatatgtttgaccactttgctgactgtattgaaaaaaccctcaccttactctgaaagaagcatggcaacagtacaatattgccgatgctttggtagtgataaaagaggtgatgggtgatataaaatcagccactcttaagcttgctggaaactgtgggaggatgtgtgaatgatgcatatttccctagagctaatgaagaagttaaaaaaaatcttagtgtctgcaaaacaggtgggtttaagatttattgatattagggaaagtgaaattaatgagctactcaagtttctgtctttggtcatcactgagagtctatttccataggaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaaggtgatggatacagaatctgagtctgaggggagcctggttgacagagagacaaaaaaagaaattttttttttctgactaaaaaaaaaaaggaaattttgttaacaaaatcaagaatttaaaaaaaatgctgtgagagctgatctatgcatctggtttgtgagccagtattctgtgatggctgcagtttttagagatcctagtagctctacacatctgtcttctgctttcctagaacctgggcaccccatggatgactcactgctggttttgtgtgtgtgtgtgtgtgatttaaaattacattcagtcaactctatagccctatgggctttttgaataaccaaatgctcaaca

SEQ ID NO: 68574 - DNA, 942 bp, Homo sapiens
cttagaggtctgtaaaggagatgactatgctgttagggctgtggtagaaacctttaataacaagtgaaaagagcttgtatttgccaaaatgaacacaggatatgattctttttttgcttttgctttggagttgtatcagctctgtgcggtcacatgggtatctacaaatcaaagcacccatcaaccagatgcatctctgagagttaacagcagaaggtggcataataaaagaagttctcggtagtgaaaaaggttggaaaccaccagctaaaccaatcctcttgtaccaataggagattcaagttgagaggtgggaaagggcctatctcagagtaggtgcttgaatacttcttactagaatgaaagaaggaacttaagatcacacagccatgttactgcaggacggggaatggaacctaggtcttcttatttttggttcagtgttaactcccattctctaagcagactgggcctgttattcaaactgccttcccataggtgcttccctgcttctctcctcacccagagaaggacttacaaacagcttatcttcagaggttttgtgcctgatagttatggaatgtgctggtttgagcagggaggatgtaaggggagggaatgctaaaaggctgtctacttagagtcaggtttcctgggtaagtccctggaaccccatccccttcccctttcttgagaccccaggacttgctccagtaactgccaccctgtgcctttgcttcagggccatgctggataaggagctggctgcctctgtgaacatcctactcaaggcatcttcactgtgagttttgctgttgccattggagggggagtggggggagtgtggggagtgctagggtcaggtcctggctggtgtaaagaacactgaattaaaggaattgtcagaataactcaaaggcatttagataatcaaaaaaaaat

SEQ ID NO: 68575 - DNA, 4759 bp, Homo sapiens
aaaattagtgcggtgtggtggcacgcacctgtagtcccagctactcgggaggctgaagcgggagggtcccctaagtctaggaggtcgaggcttcagtgagcggtgattgtgccactgcactccagcctgggcgacagagcaagaccctgctttcccctcttgtcctccactaccctcaggaaaccaagaaagaccagcgtggagagttggtcgcccatctgctctaagctgctgtgtattcccctgtaatgtaaacatcgtgaaggtggagacccagttaaccttttaggtggaaggccagatgacagagggcggcatctgacccggaaggccctctgcaaccaggccaaatacatctacagggaaccaatgggaaacatctggggaggacaacccaaataagtatcatgcgagcaagggatggtttgagaactttaaaaatcgctgctgttttgcaacatacgaagttgatggggaggaaggacccttaaatcctgagtgggtatcgagtattccaagcaactggagagaggctttgtgcctcaacaggtcttcaacgccaaggagatgacccatcttttgcagtgcatgccttcctacttttggggcaaaagacaaaaatctggaaagcttagaggaagctaaggacaggatttccctcatttttttgtggcagtgcctcaggtgacaaaatgataaaaccactgctgctttacaaagactctaacaccccacttgtcttttagagataaacgccttcctgttttcttgtaatcacacccagaatcaccactgccactttttggattagttttacaatttttttatccatcaaatccgaagtcatttaacaaaaaaaatctggaaatcagaatgttgctaactgtggacagaggtcccaatcacccagattcattattctttgttcattctaatgttgatactgtgtttctccctcaggaaggccctagctttcttcagcccttgggtcagggtataactgaagcatttgaacataatcaagcatatgtttgaccactttgctgactgtattgaaaaaaccctcaccttactctgaaagaagcatggcaacagtacaatattgccgatgctttggtagtgataaaagaggtgatgggtgatataaaatcagccactcttaagcttgctggaaactgtgggaggatgtgtgaatgatgcatatttccctagagctaatgaagaagttaaaaaaaatcttagtgtctgcaaaacaggtgggtttaagatttattgatattagggaaagtgaaattaatgagctactcaagtttctgtctttggtcatcactgagagtctatttccataggaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaagggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaataaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataaaaaaaaaat

SEQ ID NO: 68576 - DNA, 1811 bp, Homo sapiens
aaaattagtgcggtgtggtggcacgcacctgtagtcccagctactcgggaggctgaagcgggagggtcccctaagtctaggaggtcgaggcttcagtgagcggtgattgtgccactgcactccagcctgggcgacagagcaagaccctgctttcccctcttgtcctccactaccctcaggaaaccaagaaagaccagcgtggagagttggtcgcccatctgctctaagctgctgtgtattcccctgtaatgtaaacatcgtgaaggtggagacccagttaaccttttaggtggaaggccagatgacagagggcggcatctgacccggaaggccctctgcaaccaggccaaatacatctacagggaaccaatgggaaacatctggggaggacaacccaaataagtatcatgcgagcaagggatggtttgagaactttaaaaatcgctgctgttttgcaacatacgaagttgatggggaggaaggacccttaaatcctgagtgggtatcgagtattccaagcaactggagagaggctttgtgcctcaacaggtcttcaacgccaaggagatgacccatcttttgcagtgcatgccttcctacttttggggcaaaagacaaaaatctggaaagcttagaggaagctaaggacaggatttccctcatttttttgtggcagtgcctcaggtgacaaaatgataaaaccactgctgctttacaaagactctaacaccccacttgtcttttagagataaacgccttcctgttttcttgtaatcacacccagaatcaccactgccactttttggattagttttacaatttttttatccatcaaatccgaagtcatttaacaaaaaaaatctggaaatcagaatgttgctaactgtggacagaggtcccaatcacccagattcattattctttgttcattctaatgttgatactgtgtttctccctcaggaaggccctagctttcttcagcccttgggtcagggtataactgaagcatttgaacataatcaagcatatgtttgaccactttgctgactgtattgaaaaaaccctcaccttactctgaaagaagcatggcaacagtacaatattgccgatgctttggtagtgataaaagaggtgatgggtgatataaaatcagccactcttaagcttgctggaaactgtgggaggatgtgtgaatgatgcatatttccctagagctaatgaagaagttaaaaaaaatcttagtgtctgcaaaacaggaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaaggtgatggatacagaatctgagtctgaggggagcctggttgacagagagacaaaaaaagaaattttttttttctgactaaaaaaaaaaaggaaattttgttaacaaaatcaagaatttaaaaaaaatgctgtgagagctgatctatgcatctggtttgtgagccagtattctgtgatggctgcagtttttagagatcctagtagctctacacatctgtcttctgctttcctagaacctgggcaccccatggatgactcactgctggttttgtgtgtgtgtgtgtgtgatttaaaattacattcagtcaactctatagccctatgggctttttgaataaccaaatgctcaaca

SEQ ID NO: 68577 - DNA, 360 bp, Homo sapiens
ggtcgctgctcagggaaatgcggaggccagtaggcttacgtgtttaccgcgtagggcaaagccttgccaaattcccggccagcggagcggcgagggtggggactcacgggaagttaaacagcctcgtcggcgtcctcgaggcttacggccgcggctgaggcctccccaggtggagcggtggcctggaggggaatcttgatcctgggccagccacctgtcaagaggaggcggagcgtcatgcctctggaagactggatgaatattctccaggagcctgacgaaggacgtgcgccgccttgttggtgttgatcagtccaccaaggagaagcagctggtcgcagtggccgtacctgtaatccc

SEQ ID NO: 68578 - DNA, 4666 bp, Homo sapiens
aaaattagtgcggtgtggtggcacgcacctgtagtcccagctactcgggaggctgaagcgggagggtcccctaagtctaggaggtcgaggcttcagtgagcggtgattgtgccactgcactccagcctgggcgacagagcaagaccctgctttcccctcttgtcctccactaccctcaggaaaccaagaaagaccagcgtggagagttggtcgcccatctgctctaagctgctgtgtattcccctgtaatgtaaacatcgtgaaggtggagacccagttaaccttttaggtggaaggccagatgacagagggcggcatctgacccggaaggccctctgcaaccaggccaaatacatctacagggaaccaatgggaaacatctggggaggacaacccaaataagtatcatgcgagcaagggatggtttgagaactttaaaaatcgctgctgttttgcaacatacgaagttgatggggaggaaggacccttaaatcctgagtgggtatcgagtattccaagcaactggagagaggctttgtgcctcaacaggtcttcaacgccaaggagatgacccatcttttgcagtgcatgccttcctacttttggggcaaaagacaaaaatctggaaagcttagaggaagctaaggacaggatttccctcatttttttgtggcagtgcctcaggtgacaaaatgataaaaccactgctgctttacaaagactctaacaccccacttgtcttttagagataaacgccttcctgttttcttgtaatcacacccagaatcaccactgccactttttggattagttttacaatttttttatccatcaaatccgaagtcatttaacaaaaaaaatctggaaatcagaatgttgctaactgtggacagaggtcccaatcacccagattcattattctttgttcattctaatgttgatactgtgtttctccctcaggaaggccctagctttcttcagcccttgggtcagggtataactgaagcatttgaacataatcaagcatatgtttgaccactttgctgactgtattgaaaaaaccctcaccttactctgaaagaagcatggcaacagtacaatattgccgatgctttggtagtgataaaagaggtgatgggtgatataaaatcagccactcttaagcttgctggaaactgtgggaggatgtgtgaatgatgcatatttccctagagctaatgaagaagttaaaaaaaatcttagtgtctgcaaaacaggaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaagggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaataaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataaaaaaaaaat

SEQ ID NO: 68579 - DNA, 3948 bp, Homo sapiens
cttagaggtctgtaaaggagatgactatgctgttagggctgtggtagaaacctttaataacaagtgaaaagagcttgtatttgccaaaatgaacacaggatatgattctttttttgcttttgctttggagttgtatcagctctgtgcggtcacatgggtatctacaaatcaaagcacccatcaaccagatgcatctctgagagttaacagcagaaggtggcataataaaagaagttctcggtagtgaaaaaggttggaaaccaccagctaaaccaatcctcttgtaccaataggagattcaagttgagaggtgggaaagggcctatctcagagtaggtgcttgaatacttcttactagaatgaaagaaggaacttaagatcacacagccatgttactgcaggacggggaatggaacctaggtcttcttatttttggttcagtgttaactcccattctctaagcagactgggcctgttattcaaactgccttcccataggtgcttccctgcttctctcctcacccagagaaggacttacaaacagcttatcttcagaggttttgtgcctgatagttatggaatgtgctggtttgagcagggaggatgtaaggggagggaatgctaaaaggctgtctacttagagtcaggtttcctgggtaagtccctggaaccccatccccttcccctttcttgagaccccaggacttgctccagtaactgccaccctgtgcctttgcttcagggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaataaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataaaaaaaaaat

SEQ ID NO: 68580 - DNA, 3384 bp, Homo sapiens
ggtgtaactctgcctgtgtttgcatgccacctccagaaccactaaaatataatttctcagtgggtgactgagtaagactggcagcaattgcaaaagcagattcatgccatgtgtcactcttcacagtcaggaacttatttacctcttggaactttccaaaggaacgatgatggtggcgggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaataaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataaaaaaaaaat

SEQ ID NO: 68581 - DNA, 3747 bp, Homo sapiens
ggtcgctgctcagggaaatgcggaggccagtaggcttacgtgtttaccgcgtagggcaaagccttgccaaattcccggccagcggagcggcgagggtggggactcacgggaagttaaacagcctcgtcggcgtcctcgaggctccaaaaccaggctctaggcggggacgactgcagccgttatggaggccaccgcggctacggccgcggctgaggcctccccaggtggagcggtggcctggaggggaatcttgatcctgggccagccacctgtcaagaggaggcggagcgtcatgcctctggaagactggatgaatattctccaggagcctgacgaagaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaagggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaataaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataaaaaaaaaat

SEQ ID NO: 68582 - DNA, 3432 bp, Homo sapiens
aaaaataggagcatttaaagaaaactaagtgacttgtccatagtcagacagctagtaggggcaaagttagaatttgaacccatgtctgtgagactctaaagctatctggcctaactggccacttattgacagatgggaaacataggctagggagtgacaggccgtgggcctggacaggtggggtgcggcaggttgcagagggcctcccttgaggctggccagttgggttttatcacgagttgattctaatcatagtcacttatagggctttgctttctctccaaaggctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctctggtttttataaccttgcttcagctcaccttttccgtcatcatcccctccatctcctctcccacgctgggaaatggatggctgcactatactgtgtgatgttattgctatgttcatgccatcccctctgcctggaatgcccttctgcatgaatgcctgtgaaatgttgttgctcctttgtatggcctggcttccgtggttggcaggaatctcttctttcgtggtattcctgtcatctttgtgcatcacagtcagctttgtattcctagcttgtaagctacttgaggataggggcatgtctgaatctatttaatctcttgcacctgtttggcaaattgatgttttaagtatttaaataactaaagctctctctacagtacatactcacttttgatttatgaattggcaaaattcaacttttttccttgaatattcttaaagtgagatgaattccaaaggagagtgttctgtgtgtggccttcattgagtggttttctgttaccagaaagctcttggtggccttcctcttccctggtgtcaaggttgactgttataggaaatgggaggggagagggccgtttctgccacgcattgtcctaggttcttaacattatttaatccttataatgcaatgttatcctcattttacagatgaaacctgagaccaaagaacatgtaacacataaagtacattgcagagttaggatgtgaacccaactctgattctaaacctaatgctctcactctttcattcagaggttcagtcagttctttgtaggctgtagatccagagaagctgccgtagccaacaataaagttgttagtttttaaaacatctatgtggtaagttggtctggcacttaaaaatgtattgtttcccaggcacggtggttcacacctgtaatcccagcattttgggaggccgaggcaggcggatcattaggtcaaaagattgagaccatcctgaccaacatggtgaaaccccgtctctactaaaagtacaaaaattagctgggtgtggtggcgcatgcctctagtcccagctacctgggaggctgaggcaggagaattgcttgaacccaggaggcagaggttgcagtgagccaagatcatgctactgcactacagcctggcaacaaagcgagactctgtctaaaatatatatatatatatatattgtttactactcaccacagatctgcaggagttcactgatctctaggatctgccttaactccaacttacatgttttggtcactattacaaactgtcatcccagaatgatgctgcagaggctagggctaggacacagaccagtgtttccatgtgggaattccctcccagtatttcttaggaaatgtatgttttttgaatccataatccctagaaaaatcagttgaggaaatgagaagtattgtaattattctgtgaatagtaacacttaccattatggagacatcactagtttgaaagaatccaacttcatcaaatattaacgtaccgagttgaaggctacaagaactgagacaggagcatagcagagagaaacggtcaccatctcattagccctatttttggttgttgtgatgccattacatctgtatatctggccatatcagctgctaatggtgagttcttgcaaacaaaatgatttgataaacaacctaccatactttatacaaatcttatggtgttccgagaaataaactttggaagcaaaataaaaaaaaaat

SEQ ID NO: 68583 - DNA, 2934 bp, Homo sapiens
aaaattagtgcggtgtggtggcacgcacctgtagtcccagctactcgggaggctgaagcgggagggtcccctaagtctaggaggtcgaggcttcagtgagcggtgattgtgccactgcactccagcctgggcgacagagcaagaccctgctttcccctcttgtcctccactaccctcaggaaaccaagaaagaccagcgtggagagttggtcgcccatctgctctaagctgctgtgtattcccctgtaatgtaaacatcgtgaaggtggagacccagttaaccttttaggtggaaggccagatgacagagggcggcatctgacccggaaggccctctgcaaccaggccaaatacatctacagggaaccaatgggaaacatctggggaggacaacccaaataagtatcatgcgagcaagggatggtttgagaactttaaaaatcgctgctgttttgcaacatacgaagttgatggggaggaaggacccttaaatcctgagtgggtatcgagtattccaagcaactggagagaggctttgtgcctcaacaggtcttcaacgccaaggagatgacccatcttttgcagtgcatgccttcctacttttggggcaaaagacaaaaatctggaaagcttagaggaagctaaggacaggatttccctcatttttttgtggcagtgcctcaggtgacaaaatgataaaaccactgctgctttacaaagactctaacaccccacttgtcttttagagataaacgccttcctgttttcttgtaatcacacccagaatcaccactgccactttttggattagttttacaatttttttatccatcaaatccgaagtcatttaacaaaaaaaatctggaaatcagaatgttgctaactgtggacagaggtcccaatcacccagattcattattctttgttcattctaatgttgatactgtgtttctccctcaggaaggccctagctttcttcagcccttgggtcagggtataactgaagcatttgaacataatcaagcatatgtttgaccactttgctgactgtattgaaaaaaccctcaccttactctgaaagaagcatggcaacagtacaatattgccgatgctttggtagtgataaaagaggtgatgggtgatataaaatcagccactcttaagcttgctggaaactgtgggaggatgtgtgaatgatgcatatttccctagagctaatgaagaagttaaaaaaaatcttagtgtctgcaaaacaggaagaagtctttgcagaggaaattgaatgctgtctgatgctacaattcatatggatcctttcctggattgaagcctgacttttaaaaaaggtttcaataaattgcttatacctatgaagagatgcaaaagaaccttcaaaataaagcaaaggacttgaagaaagagaaggaagacatgaagaagaggatgtcatttaggtgaagggccatgctggataaggagctggctgcctctgtgaacatcctactcaaggcatcttcactgctgtacatccttttgaaatcccagagatcttcagtctccctgtggattaaggagatgtgcagtatttaaagtggcttcaggaaggcatggaagaggactgagtggggaaagctttttgtgcatgctgctggctacctccagcggctgcctccagcctccatcagctgcactctggggaagaggaggctgccttctacctcccagcatctctggatttcatgttcctgtcagcacagaggagctaaatggcctgtagaggctgaaggtctgaggctcctaaagctggaagaaaaggctgggccagtcaggccaagcaagaacacagtgtaacttgtctctgagtgcttcatggttaagggggctaagcaggcacaagggcatgaggatggttatatgtacagactgaggggaagaaagcagtgaagatgagacttgccatcttcttgagtcagtaggcctgcctcaggtgcctaggatgtaattgctctgctgcttctcatggggaggagtggccctcatgaccttgtttacctggaagagtgtgggatgaatgcctcctcctatggggactcgcaagtgctttagcaaaaggataaattgctaattgtggcatttcgtggatcagcaggattatttctccttgctaaagaggattttgttggtcctgaattctgaggaggtgggactaggaatgggctccatgagcctgtgtatgactcagggaatattaggactttggcacagcctcatgggttgggagtaagtcttggctcttccctagcctgaatgacagacatcagatcattctggtgctttgtccatgaagatgtagattctgagcccacccaactaatcttttcacttgagcacagaaacagccccgggaatcggacagacccgtgtctttcaggtttgcttcacagagccccaggggttgacaataggtgccttggagactgcctgcatggggatttttaaaaagctttctttgttaaaggtttgtaaaccactcctctgagcctgttttcattttatagattattcagggaactgaactgcacagagatccagaaagtgggtagtgcaggctgtagtgctgataactactgtactacttggatctttgtgctcccaaataccaaatggaagaggatctctgagagtcctttgcaaagatcttgtagggactttaggctggggccttcggaaaattccagaggattccaatggagattttgagggactgactcagaagaacaaagagaatgataatggtgatgtccctgctttttacaacagatcatgttctgatatatatgcaaatctgtgtaaagtaaaccctacctaaaatgtactggggacccaagatggactgcctgtattgcttccaggataaagtccaatttctagctc

SEQ ID NO: 68584 - DNA, 262 bp, Homo sapiens
ccaaaaccaggctctaggcggggacgactgcagccgttatggaggccaccgcggctacggccgcggctgaggcctccccaggtggagcggtggcctggaggggaatcttgatcctgggccagccacctgtcaagaggaggcggagcgtcatgcctctggaagactggatgaatattctccaggagcctgacgaaggcgtgagtaatagggacgtgcgccgccttgttggtgttgatcagtccaccaaggagaagcagctggt

SEQ ID NO: 68585 - DNA, 677 bp, Homo sapiens
ggtgtaactctgcctgtgtttgcatgccacctccagaaccactaaaatataatttctcagtgggtgactgagtaagactggcagcaattgcaaaagcagattcatgccatgtgtcactcttcacagtcaggaacttatttacctcttggaactttccaaaggaacgatgatggtggcggtaatgtcacattagtatggagcccttaaattcagcagtgttcaacctgagggaagacagagtaggtcaattctcttggcagcagctgagggaaggagagagcagggagcagggctcagataaggtttgtttggcagggtccaagcacttcatggaatggagacctttggctgtcagagatctgaggaagatttgtcagggcctgctacactctgagggcttgcagtttggatggttgggaacacttcttccttgcactgatggtgctcctatttctatgacacgtgtactagttcagacacaatttattgtgttcaccaattctatgcacagcaatcagactgagattgaaatccagtataatattaaaggtgatctgggccaggcgcagtggctcatacttgtaatcccagcactttgggacgctgagttagggggatcacttgaggccaggagtttgggaccagcctgggccagaaaatgagaccccatctgtaaa

SEQ ID NO: 68586 - DNA, 474 bp, Homo sapiens
  misc_feature (453)..(453): n is a, c, g, or t
agccacttcatttatcctctctgatcttcaggcctacctcatgtcctccccaaagagatggtgggtaagagagaactttgcaaaaggctgccagagcataaataggtcttatgactatgtagcagaaaaatgggacctcaaagaggagagagacctgcaaagcgggggactgctgccattctttgagtggtggctcaaaatatttccccaaactgtccccatctggtcaggatgccccacagccttttactaagatggtgtcttcatctagcctcagcccagctgcagtacctttctggaactcccaccactgatgctcaagaggagagtttaagttcaagagggttaagctctctacccacccgctcatccacagtccctcagacaagcatgcagatacatgctttgtttggttggttggttggttggtcggtcggttggttttgtttcaanacgccatctcaaaaaaataaa

SEQ ID NO: 68587 - DNA, 397 bp, Homo sapiens
attttgttttagtgagccttggggcaatacaaaaaattaagagtgactaagtagaaaataaaggacgggaggataattagaatttgtttttaaaaatcggctagtactttaaaaggtagttcctatagttgcaatatggattaatgactgtttaaaaaagttcataagtttctgctcaaatccaaaactaagatatctaaaaatggtactgacattattaactgcttgaatgcctattgtcaagagtagtgtttggcacccaccacaggtatttattgaaaacataaaggaataaaatgattcccaaatgatatcatcttatgattaatgaatacacatttgaggacctagaacttttagcagtaagatttgcatacgcttttcctattgaatttaa

SEQ ID NO: 68588 - DNA, 356 bp, Homo sapiens
catggaattaactcttctttgtcctcctgtcctgttatacaatagaagctccaagtcttattcacaactttgagtctagtgtgtggctgtatagaacagagattaagagcatgggttcaagggtacgatggacctggatttgaattcaaccgagcaactttttgtgtgacttagaggtagtcacaccacattactcagttttctcatctgtaaattgataatagttcttacctcatagaactattgtgaaaattaaattcactcacatatgtaaagcatttagcttgccccggcagtaaatattcactactattattgcattaagtgctaaaagagtatttcaagtagaattttta

SEQ ID NO: 68589 - DNA, 423 bp, Homo sapiens
gtttcccttctataagatggctaatatgagggctgtgagaactaagggaaagaattcatgaaaattcctcaataaatgttagctgctgctaatactatcatcatcaaagtctgtgtttagaccaggcatggtggctcacacctgtaatcccaacactttgggaggccgaggtgggtggatcacctgaggtcaggaggttgagacctgcctggccaacatggtgaaactccgtccctactaaaaatacaaaaaattagctgggtgtggtggggcatgcctgtaatcccagctactcaggtgactgaggcacgagaatcgtttgagcccaggaggcggaagttgcagtgaaccaagaccgtgccactgcactacagcctgggcgacagagtgagactctgtctcaaaacaaacaaacaaacaaac

SEQ ID NO: 68590 - DNA, 5002 bp, Homo sapiens
  misc_feature (107)..(107): n is a, c, g, or t
  misc_feature (755)..(755): n is a, c, g, or t
  misc_feature (4295)..(4295): n is a, c, g, or t
  misc_feature (4918)..(4918): n is a, c, g, or t
ggatccattttataagctcaaagataattacttttcagactaagaatatttagggtaaaaagtactgttcaacatctctactgaggatgttatgatgtagcacactntataagctggagctaaaggaaactttccttaaagtgctatttactaaaaattggaacacattccttaagacaaatcgaagtgtggcacacaacatccaaacttccatcatagatacagaggtgttaccatctcccactcccaaatttctttgtcacgctgaggatactcaagaggagcaggacatgttggtcgcagcaggagaaacttgaaagcattcacttttatggaactcataagggagagaatctcttatttagtatcgtccttgatacatttattattttaaaagataatgtagccaaatgtcttcctctgtgttaaatctttacaaaactgaaatcttaaaatggtgacaaaaattctacttctgatagaatctattcatttttccaattagatagggcataattcttaatttgcaaaacaaaacgtaatatgcttatgaggttccatcccaaagaacctgctattgagagtagcattcagaataacgggtggaaatgccaactccagagtttcagatcctaccggtaattggggtagggaggggctttgggcggggcctccctagaggaggaggcgttgttagaaagctgtctggccagtccacagctgtcactaatcggggtaagccttgttgtatttgngcgtgtgggtggcattctcaatgagaactagcttcacttgtcatttgagtgaaatctacaacccgaggcggctagtgctcccgcactactgggatctgagatcttcggagatgactgtcgcccgcagtacggagccagcagaagtccgacccttcctgggaatgggctgtaccgagaggtccgactagccccagggttttagtgagggggcagtggaactcagcgagggactgagagcttcacagcatgcacgagtttgatgccagagaaaaagtcgggagataaaggagccgcgtgtcactaaattgccgtcgcagccgcagccactcaagtgccggacttgtgagtactctgcgtctccagtcctcggacagaagttggagaactctcttggagaactccccgagttaggagacgagatctcctaacaattactactttttcttgcgctccccacttgccgctcgctgggacaaacgacagccacagttcccctgacgacaggatggaggccaagggcaggagctgaccagcgccgccctcccccgcccccgacccaggaggtggagatccctccggtccagccacattcaacacccactttctcctccctctgcccctatattcccgaaaccccctcctccttcccttttccctcctccctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtggnatgtctttttgttttggtcaggattatgaggtcttgagtttttataatgttcttctgaaagccttacatttataacatcatagtgtgtaaatttaaaagaaaaattgtgaggttctaattattttcttttataaagtataattagaatgtttaactgttttgtttacccatattttcttgaagaatttacaagattgaaaaagtactaaaattgttaaagtaaactatcttatccatattatttcataccatgtaggtgaggatttttaacttttgcatctaacaaatcatcgacttaagagaaaaaatcttacatgtaataacacaaagctattatatgttatttctaggtaactccctttgtgtcaattatatttccaaaaatgaacctttaaaatggtatgcaaaattttgtctatatatatttgtgtgaggaggaaattcataactttcctcagattttcaaaagtatttttaatgcaaaaaatgtagaaagagtttaaaaccactaaaatagattgatgttcttcaaactaggcaaaacaactcatatgttaagaccattttccagattggaaacacaaatctcttaggaagttaataagtagattcatatcattatncaaatagtattgtgggttttgtaggtttttaaaataaccttttttggggagagaattgtcctctaatgaggtattgcgagtggc

SEQ ID NO: 68591 - DNA, 590 bp, Homo sapiens
cgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggtgagggcccgggacggggcacgcccagcgcgtccgggagtagcggttccgttggcggcggcggccgc

SEQ ID NO: 68592 - DNA, 1938 bp, Homo sapiens
  misc_feature (1231)..(1231): n is a, c, g, or t
  misc_feature (1854)..(1854): n is a, c, g, or t
tgctcagccccaaggagaagggaaccacaaagggcaagtttggaccgagcaggtccacctgcgtcccctgatggcaagcacaagcaccagtgccaaggaagaatccagtgggtggccaccaagcacccagagttgtacacagacctgaagcttggaaacctcctcagctgcaaattctctgcatgggaggcatcctaagctcctgattcaggagagtgggtgctccagatgcctggagatctgctttggcatggaatagagaggggccccctgcaccaagatctctacacaggaggggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtggnatgtctttttgttttggtcaggattatgaggtcttgagtttttataatgttcttctgaaagccttacatttataacatcatagtgtgtaaatttaaaagaaaaattgtgaggttctaattattttcttttataaagtataattagaatgtttaactgttttgtttacccatattttcttgaagaatttacaagattgaaaaagtactaaaattgttaaagtaaactatcttatccatattatttcataccatgtaggtgaggatttttaacttttgcatctaacaaatcatcgacttaagagaaaaaatcttacatgtaataacacaaagctattatatgttatttctaggtaactccctttgtgtcaattatatttccaaaaatgaacctttaaaatggtatgcaaaattttgtctatatatatttgtgtgaggaggaaattcataactttcctcagattttcaaaagtatttttaatgcaaaaaatgtagaaagagtttaaaaccactaaaatagattgatgttcttcaaactaggcaaaacaactcatatgttaagaccattttccagattggaaacacaaatctcttaggaagttaataagtagattcatatcattatncaaatagtattgtgggttttgtaggtttttaaaataaccttttttggggagagaattgtcctctaatgaggtattgcgagtggc

SEQ ID NO: 68593 - DNA, 392 bp, Homo sapiens
tacttaataatttttggagctttaaatatgtattccacatgctatgtgaggcagtaaatgaattttggttttattaaatcattacataaaagagggactgagttcaattatctgaattcctagttactaattaggaatcagataatttctaattatctgaatacctacttcacaacccagccaaaataaagggctggaatgtcatttttaaattctatgattcaataatttattgtacatttaaaaatgactgaaagagtgtaattggattgtttgtaacacaaagaaaggataaattcttgaggtgagggatattccatttacccttgtgtgattattacacattgtatgcctatatcaaaatacctcatacaccacaaaaattgaaaatt

SEQ ID NO: 68594 - DNA, 610 bp, Homo sapiens
ctagaggattccctcgaatcgacggttctctaaagctaatacagttctgggtccttagcgaaaagtgcatacatccttatctttaggaacccaatcttagtgctgacctgcaatactgtaaacatgaaggtggtatttccaactcatcatctgtagatgatgttctaattatgctgagggctgccatccattcccttgaaatgaacatctgcatttggaagattgctggctagaattaggggacagtgtgcaccaatggaaaagaccctttgctgtgtgcaaaaggtattgttccattcaggaagcaacccatgctgacttcctccagtcttgagcactgtgctctaaccacatgggctctattgtttagaaaacacacacacatatattgctgctataggaaaattattctgacaaaatgccttacaaaaagggattagttactactgaaaaacacaaaaatatcagatgttgatatttcaccagcttgaaaagcaaacaaccatgtctaggtactttcccgttatttcctaagatagagcaggtgtggtatctggaagtgtgggcacatggacatgtggatgctccacagtgcctctgaaggagggga

SEQ ID NO: 68595 - DNA, 656 bp, Homo sapiens
ctaaaaagaagtggaagatttcaacattctacccagaagggaggcaacaatgggcagatatctgactttttttctctaaagctaatacagttctgggtccttagcgaaaagtgcatacatccttatctttaggaacccaatcttagtgctgacctgcaatactgtaaacatgaaggtggtatttccaactcatcatctgtagatgatgttctaattatgctgagggctgccatccattcccttgaaatgaacatctgcatttggaagattgctggctagaattaggggacagtgtgcaccaatggaaaagaccctttgctgtgtgcaaaaggtattgttccattcaggaagcaacccatgctgacttcctccagtcttgagcactgtgctctaaccacatgggctctattgtttagaaaacacacacacatatattgctgctataggaaaattattctgacaaaatgccttacaaaaagggattagttactactgaaaaacacaaaaatatcagatgttgatatttcaccagcttgaaaagcaaacaaccatgtctaggtactttcccgttatttcctaagatagagcaggtgtggtatctggaagtgtgggcacatggacatgtggatgctccacagtgcctctgaaggagggga

SEQ ID NO: 68596 - DNA, 725 bp, Homo sapiens
ggttaattctggctccttagaaaggatctaatttttgatggtataggatcctctggaaagcatgccaactgaaggggaatgccggtgtgaattcatgtgtcacatttatacatcagaggcaccaggctcatctgccccccaaaaaagtttcatatgaagttccagtgcatttaaacattgcctgtgttgaatcagaagtctttttggcgtctccacagctcatgaaagcaattgccagctaaatagctgcattctacaaaaggacagtgaactgcttgcttgcagtttaacccagaatcttacttcaaccaccaccatttgactagagataactaactcctgtctcagtttcaccatttctttttgccagcaatgagtcgtagaaggaatgtgcctgggaagtttagaactcaaaatgaaagtatggccagatgggttgacattggaatgaggttgactagaagagtggtgataaaatgactctggaaaaagaatgtcaccctgcattttgttagatatttattccacttcccctgtagccaaaaataaagagaaaattccttgagctccttggaggaatttcttgtgaacaggagcaagtacagcaagcttggcttagaagcctggtagaagaaggagaaaacttgaacagcatcagaaatagaagaagaaaaagacaaaatacatttccttccacagcaagttcatctagcaatggaaaaaga

SEQ ID NO: 68597 - DNA, 344 bp, Homo sapiens
ctgtgctgttgtttaggctgttctgtctgaatgactttgactcctcccactacatttaaggatcatttgcacaaatatttaccaagcactacaatatgccgtgtacttcattcagcctgattcctcacaaggaattggccagtctcagctggccacggtggctcacgcctgtaatcccagcactttgggaggccgaggtgggcagatcacctgaggtcaggagtttaagaccagcctggccaacatggtgaaaccccatctttactaaaaatacaaaacttagctggacatggtggtgggtgcctgtaatctcagctactcgggaggctggggcaggagaatcg

SEQ ID NO: 68598 - DNA, 409 bp, Homo sapiens
gtctcgagtaaataaatctagagtcccccaatctctttcaaattactgttgctctaaagaatcttcaagagctatcactgtaggctgggtgcagtggtacacacctatagtcccagctaatcaggaggctgaggcagaggatcacttgagcccaggagttcgaggctgcgttgagctgtgaccacacctgtgagtagccactgcattccaacctgggcagcatagtgcgatcttgtctcttaatgaataaataaataaatattatcatgaggattgcagttgcagcaggaaaagtcaacacagcacactactttacccctatgctttgtctgaacccaagcctaactctgggaacagggcagttgttctttccctgggttgagaactgcttgttattgctactgaggcc

SEQ ID NO: 68599 - DNA, 203 bp, Homo sapiens
tgacttgtgataacaatttctcaaggcacaaaaattccctatgaaaaacatgtataaactgacttcatcaaattgaaaaaccttgcctcaaaaaacatagttaagaaaaataggaaaacaagccacagactgagaaaatgtccacaatgtctctgataaaaggcttttttccagaatagtaaagaactgttataactcagtta

SEQ ID NO: 68600 - DNA, 429 bp, Homo sapiens
ataagttgttcctgagttggggagagaggactaccggagaggggactacgacaggccaggagggttacactggaagtagtcctcacatggaaacttgagccccagaaaatgtggattacctcatcacatgcagttagattggctggaactccttttatttttaagctttcaagaaattatgaattttaattcctaaatattatttgtctatttagttccagaataacttaatatctctggcaattcttgtcctcaaagagaatatggacattttgtcataaatatgtgtcaattgtatttatttgtttattcatttatttccattcctatcaaactgccttaattttttttaaacatctttttctgagatataaatcatatagcacacatttcatgcatttaaagtatccaattcaatggtttggggta

SEQ ID NO: 68601 - DNA, 442 bp, Homo sapiens
attttcaaatcttaatagctgctttgccatgtgtaaaattagttttcagtatgcaagaatatgagagactagaatagtgtattattgtcatatcataagggttttataatttgtcaggttattttatgtatctttttgcttcagtacaatcatatgctagtggcatagaagattatttcccagctagctgcggtactcatgcctataatctcccagcactttgggaggccgagatgggagaatcgcttgagtccaggagttagagaccagcctgagcaacatagtgaaatcccatctgtacaaaaataataataataaatttagccagttacagtgatgcacacctgtagtcccagctactcaggaggctgaggcagggggttccttgaacttggggtcagggctgcagagtgagctgtggtggtgccactgcactccagcc

SEQ ID NO: 68602 - DNA, 386 bp, Homo sapiens
atccttggactgactgcccctgtctgtatggtagggtggaaggagcactgaccagaaagtggggaagccttagtgtccaaggctctgccactaacagttttgtgacttaggcaggtccctcagtctcagcaggaggggctggaatagataaagtctcttctgctgtggtgccagccctgatcctgtcccccttgggcctctggcctccctttcccccatactaggtgatcctggagtccatggtcagcctgacacaggagttatgccctgtggccatgcgggtggccgagggacacaacaagatgctgagcaatgtggcggagcgtgtcactgtgccccggaacttcatccgaggggcactgctggagcaagcaggacaggacatt

SEQ ID NO: 68603 - DNA, 1678 bp, Homo sapiens
  misc_feature (13)..(13): n is a, c, g, or t
  misc_feature (44)..(44): n is a, c, g, or t
  misc_feature (67)..(67): n is a, c, g, or t
  misc_feature (74)..(74): n is a, c, g, or t
  misc_feature (106)..(106): n is a, c, g, or t
  misc_feature (126)..(126): n is a, c, g, or t
  misc_feature (175)..(175): n is a, c, g, or t
  misc_feature (186)..(186): n is a, c, g, or t
  misc_feature (209)..(209): n is a, c, g, or t
  misc_feature (217)..(217): n is a, c, g, or t
  misc_feature (222)..(222): n is a, c, g, or t
  misc_feature (251)..(251): n is a, c, g, or t
  misc_feature (269)..(269): n is a, c, g, or t
  misc_feature (583)..(583): n is a, c, g, or t
gagatggagtctngctctgtcgccaggctggagtgccgtggtgngatctcgactcactgcgacctcngcctccngggttccagcgattctcctgcttcagcctccngagtagctgggactacaggngcccgccaccatgcccagctaatttttgtatttttagtagagatgaggnttcaccatgtnggccaggatggtcttgatctctngacctcgngatcngcccacctcagcctcccaaagtgctgagnttacaggcatgagccgcngcgcgtggcctcctcttttattaacaggagctttctctgccccattccccccatttataaatgaaagataacaggttttatgtggctgggaatcaaatcatggaaggtgtccttccaacttaagattttgagattccttgtgtaaaaactgttgaagtctgactcttccttgtagctgcctgattacagagcttcagagaggagctgggcaggtcccggtgctctgctgtgccatatgcatgagcagtgctcctttgggtagtcttcagttgactgtagaaggtgtggagtggataagattattgggaagtacngggtaagtcacatagaacaaagatttgatttaaactgactagcttaaatgtcactcctggccgggcgcgtggggaaattatttaaatgtgttggctataaactagtgttatgtcatggatctggatatatgagtatggttataaaaatcaggatgcctggcctgatttggagcttggaaggaggttctgcggctgttgtacacagatactggagtatctgggagatatcctttggatgctgaggtgtgtctgaggccaaaggacagaatataggaatatgggagaatttaggccatgtggtcattgttcacggggccactagtttcactcactaaaggagtgggttcgtagctgcgttggagactgcagcacacccgtagcagtactgtttctcatgcagtggctttcccacagagcccagctcaggtttgctggtctcacatcaaagtgcattcaaagtggggagattgacaaagatgcaggttctgggtcctgtgaccagaaattcggactcctttagtccgacatgaagcttcatctgcctttgtaactagctctgcccatggccgtggcccacaggttgagaaactttgtccagcctattaccattcagttgtatgttttgagctgtcttttattactaagtgaaaactgggtgagattgttgaagagggacgattgccacaggggtttcctgtgttcttaatctcctgaaacttgaggacctcatggttacaccctgccctacaagttttctcttacccgtttattcaggatgtcacacagcattatttattaatatttgaaaggtctacccctgagtaaggagggtggatatatatttttttaagtggaagaaaccaaacttcaactcctatagctctctgtgcttgaatcttgtaacaggctgctcttataagcagtgccccagatccttctaatgggggaacctcacctgcccttgtcaggaaagaagggggaagggcccaggaaccttccagtctgagaggctggtattctggttctttcatcgtgtgacttatactagtgatccctatcttcttgggggcaagtggggaagccattctcctcttg

SEQ ID NO: 68604 - DNA, 1123 bp, Homo sapiens
gcggccgcgcgcgctccccgacgcccgggcccgcggccacgacgtgcgcttcgcggagttcctggcctacctgctggacccgcgcacgcggcgtgaggagcccttcaacgagcactgggagcgcgcgcacgcgctctgccacccgtgtcgcctccgctacgacgtcgtgggcaagttcgagacgctggcggaggacgcggccttcgtgctgggcctggcgggcgcatccgacctgagcttccctgggccgccgcggccccggggagccgccgcctcccgcgacctggcagcgcgcctcttccgggacatcagccccttctaccagcggcgcctcttcgacctctacaagatggacttcctgcttttcaactactccgccccctcctacctgcggctgctctagcggtcctggaggtcctgtggccacgcggggcaagtgcctttccgacaagacccccggggaatgcaggtgctgccggccccaggacccctcttcaagagccactgcgtgcactcacctggccgccgggccagcgggcgcagggcacacctggccaggcttgggggcagcccatctcaggtggccctgcacgcgtgtgcctgcctcggcctgtcgcctgaggcctgcttcctccacttgctccagctgacaggcacctctccaggccccgtagatgggcaaggacttgataaccagggttttaggcttttaaaggccattttgggggtcagccctgcccctgaacctgttcatggtgcatcagaacataatgctgacaccggtgtcagtgtggcccgagcctgtgtcctccccacctcgcccaccctggcaaggacagctgcggccaaggacgaaagccctcccttggctggcctcacgatggggccgtcccgggagccaggtgggagctgccttccactgccatcgggtctcctctcctctcccacgcggctggccctacccaggcgccacttcggtctcagtctggcaagacgctgggtcttcaggctccatgccaacagagcccctggtgcaatgcggtcacaggttttatgggactttggtgagctgggcggtcatggttttgaaataaatgtattttgttactttctgaaatttgga

SEQ ID NO: 68605 - DNA, 380 bp, Homo sapiens
gcttggtattaaacactgaagctttgtgtagaatatgtcagtaggcgatttactacctcaaaaagcagtctttcttttgtaaaggcttatcaatcagaactttggagagaattttccaaactccctaaggaaaattatatttcattgctatgaaagatatttgattttgtgcattttgcttcataaaatgaatttgtttcagattctgaatacttatgatttttgtttgtgtctttatgaattactttaaagcaatttcccttttacatttaaatggtttcagttcttaaaaacatttatgttcaccagaagttggctttttttttttttttcttaaatgaaaagtataagggattttaacctcataaagaataaggaaa

SEQ ID NO: 68606 - DNA, 634 bp, Homo sapiens
aggggaggtgctagaagtcggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctagtaggtttttactgggattagtgaaacaactgctatgttctcagcaacccactccaaagccaaagtcaaaactaaaattgtaaaatatctcaaaaacaataaaaatggtatatatatatcagaagctctggtatatagcaaaactgtactaaaaataatttagaaaaataatttatctcatgcaaatgaataaaaaaatctaaatgaaaa

SEQ ID NO: 68607 - DNA, 971 bp, Homo sapiens
aggggaggtgctagaagtcggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctagtaggtttttactgggattagtgaaacaactgctatgttctcagcaacccactccaaagccaaagtcaaaactaaaattgtaaaatatctcaaaaacaataaaaatggtatatatatatcagaagctctggtatatagcaaaactgtactaaaaataatttagaaaaataatttatctcatgcaaatgaataaaaaaatctaaatgaaaaaaaaccacgccccaaaagggggggggggaaaataccccgggggcgccaatctgcggcaccccgtttatgggaagaagcgccgccacgaggagagcttaaaggacggcgcggcgggtgcaaacgaccgccgcaggggaaaagcgcaggggcattggaagacccctctggggcgggcatggaccccgagaagtacgcgagacaaaactaggcttggtacaggttctgcggaatgtacgtttatactgcacgggacaatcagcaacaagcgacaacgtcacacgcgagcccagcaggcacagatgacactgcccgcacgaggacagcacgacaacgccac

SEQ ID NO: 68608 - DNA, 1775 bp, Homo sapiens
tcagagttgattacacatcacagaattcatactggagagaaaccttatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgtgggaaaggcttcgttcagaaatcagtgttcagcgtccatcagagcagccacgcttgagagaaacagtgtgagaaaacccccctgagggttgggtctgattgtacactgttgcacgcatgcagcagaaaaatatgtatattattgtaaatagaaatgaccacagcagaatgtcacacatggctgttctggagagggcctctgagaaggcactgaatgaggcgagggacccttcctacattgtcaccatccccagtaaaccttgggtcattattcatactgacaaggaaccgagtcaatttggtgaataggaaaagccttctcatgaaaactacaatagaatactgttaccaaattcttcctaagaaagatcgtattaagttaacgataatcctgtttactgtggattaggtatagtgccaacaaattgaatgataaaacaacataatacgtagttattttgatagtgatgaatcctaagttatgtgagttgttcgttgtggaacacattgtgtaacagactcctgggtgtttttctttctcattcgaatctaccacagttggtcatatccaaccctcattcagtatttctatcaagaaagagatgctacaaaaaaaaaaagaaaaaacctttatgtatacagacgtaaacctcagaatgtatgttgagtccccactgtcatctaccaagacttgcacccccctcattatctaccatgactgtctctcagcctcacgggccctcagcactttgtgttttgacccccagcaccgtgtcttgtgaactcccatcaccttcaagaaagcttccgaggtaagaattttatggtcatctgggacaacttaaatctcccttctgctgtcatagttcttccaactcagttgcctttttttttttttcgtactcatcactgacttgaagcttagtatctggcttccttaaggatgtaactttcatgtaacagattaataacttatatgaaaaccaacacaaccatatgtttagggctggaaagggccatgacgcctggccatttttcctgttttaccttactcttatgtgtgtcacacttcatcaattccggaaacagtttctggagatctcctcattacctcttttacaatcacctcactccagcatggtgtctgttacctcttcccacttgtgacaatgtctagtaaggtccactctccattctgtgtgatgaccacttattacaaccctcagaataggggacagtggtgtgccccctgcaatacaatggtttctatctcctgatacttttattacacctctagcaggatgtcttgtgatcctccttattgatttttccctcacgatgatgaacaattatctcccgttactcacctagcagtatctaactgtccctaacacagcatgtgggaatgccctcaatacggtggatgctgttaactttcttccttcccctcaggcaatggcggtgacttacaatgaaccataatgtccacatttcccaactgtattttggagcctcttctgtccccttctttctaggaccccagtt

SEQ ID NO: 68609 - DNA, 1624 bp, Homo sapiens
aaaaccatatgagtgcagtaactgtggcaaatccttcatttccaagtcacaacttcaggtacatcaacgtgttcacacaagagtgaagccctatatatgtaccgaatatgggaaggtcttcagcaataattccaacctcgttacacataagaaagttcaaagtagagagaaatcttccatatgtactgagtgtgggaaggcctttacctacaggtcagagttgattattcatcagagaattcacactggagagaaaccttatgaatgcagtgactgtgggaaagccttcactcagaagtcagcactcacagtgcatcagagaattcatacaggagaaaaatcgtatatatgcatgaaatgtggactggccttcattcagaaggcacacttgattgcacatcaaataattcatactggagagaaacctcataaatgtggtcactgtgggaaattgtttacctccaagtcgcaactccatgttcataaacgaattcacacaggagaaaagccctatatgtgcaataaatgtgggaaggcattcaccaaccggtcaaatctcattacacatcagaaaactcatacaggagagaaatcttatatatgttccaaatgtggaaaggccttcacccagaggtcagacttgattacacatcagagaatccatactggggagaagccttatgaatgcaatacttgtggaaaagccttcactcagaagtcacacctcaatatacatcagaaaattcacactggagagagacagtatgaatgccacgaatgtgggaaagccttcaaccagaaatcaatactcattgttcatcagaaaattcatacaggagagaaaccctatgtatgcactgagtgtggaagagctttcatccgcaagtcaaactttattactcatcaaagaattcatactggagagaagccttatgaatgcagtgactgtgggaagtcctttacctccaagtctcagctcctggtgcatcagccagttcacacaggagagaaaccctatgtgtgtgccgagtgcgggaaggcctttagtggcaggtcaaatctcagtaagcaccagaaaactcatactggaaagggccatgacgcctggccatttttcctgttttaccttactcttatgtgtgtcacacttcatcaattccggaaacagtttctggagatctcctcattacctcttttacaatcacctcactccagcatggtgtctgttacctcttcccacttgtgacaatgtctagtaaggtccactctccattctgtgtgatgaccacttattacaaccctcagaataggggacagtggtgtgccccctgcaatacaatggtttctatctcctgatacttttattacacctctagcaggatgtcttgtgatcctccttattgatttttccctcacgatgatgaacaattatctcccgttactcacctagcagtatctaactgtccctaacacagcatgtgggaatgccctcaatacggtggatgctgttaactttcttccttcccctcaggcaatggcggtgacttacaatgaaccataatgtccacatttcccaactgtattttggagcctcttctgtccccttctttctaggaccccagtt

SEQ ID NO: 68610 - DNA, 636 bp, Homo sapiens
gggggtcagtgatgggagtctgtggtcagtgacagagcctgtagggtcagttatggtgatcggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagtgttaaccttgatgcctgaaagaactggaaattatgaagatagattcagaagtcaaatatgttaactaactgcattgaagagtagaagaaaacaatagcctaggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccaggagagaaattatgggaccataatcaatgtagaaaaa

SEQ ID NO: 68611 - DNA, 710 bp, Homo sapiens
aggggaggtgctagaagtcggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccagcaccgtgtcttgtgaactcccatcaccttcaagaaagcttccgagggtgaaggtacgctcgagcgtggtcaatgaggacaagtcgaccgagagattcctgagtacgtctatggtcaccctttgcggtaaacttgtgcgctcagaagaagccagggtaacaatgggaca

SEQ ID NO: 68612 - DNA, 676 bp, Homo sapiens
aggggaggtgctagaagtcggaccggaagtggaagtggtcttccaaggcttttttgccgctggtgtcaggagtattttcatattccaataccgataaatctttgaggtttctgggtgtctctggggagcccctgggccagattttcctctagactccagcccatctcttcagagcagctctgcttgagttcacagatgactgccaagcttcagacaccctacagaaaaagggttgagacccagtgtggccatgccagctaattggacctcacctcagaaatcctcagccctggctccagaggatcatggcagctcctatgagggatcagtgtccttcagggatgtggctatcgatttcagcagagaggaatggcggcacctggacccttctcagagaaacctgtaccgggatgtgatgctggagacctacagccacctgctctcagtaggatatcaagttcctgaagcagaggtggtcatgttggagcaaggaaaggaaccatgggcactgcagggtgagaggccacgtcagagctgcccagtgacacaccgactccccctcccttccaccatgactaaaagcttcctggacctcaccagaagccaagcagacactagtgctatgctcgtacagcctccagaagcatgagctaagtaaatctctttttattataaa

SEQ ID NO: 68613 - DNA, 628 bp, Homo sapiens
cggcacgagggatgaacaaaagtgcagggatgactcctgagggtcttacttattaaatgggtcaggcaatgaatgaagactggcttgtaagctacaaggtagtttcgcccatttacacgaagacaatttcatgtattatttaacccgttcctatacactggtgtctctttgctgtccagcatgaaataaatatgaaataaatataagcttacaaattaatgaggtctgacttttattttcaaaataatctgacaattacttggtttcatccttttgtttggattctagcttgctttctcagaacagctagagaatgtgtatgaagtgtgcgtgtggagggggcaagggaagggaataaaaatgcattgcttcagggctgcacatctgtttttaaaaaactctgcaagatctgcccgttaaccactgtcacaactcctgctgtttcctgcaattgcattccaatcagagatgttcgtaccagctcaagatattgcaagtaaacagatttaactgttacaagttagtttcctattctcgtgcctcacagaattcttttttcttctcgagccgatagcacttgcatgtatggtacacataatgagtggtaacccattttctttctttttca

SEQ ID NO: 68614 - DNA, 449 bp, Homo sapiens
ccgtcaccaacatgatttcaaacggagcctgtggcctggtgacctggggccttgcagccagagacagtgaactgtcaggtttgggatggatgagagatttccttcttttgtaaagcggcagaactattgtgaaaggggagtagagaaaagagaacaccaggggctttcctgagcagatcatcactttcagaaaagagtacactgaacgtttaaaatctggaaattgaactccttaaaattatttgcatttgggtgctccttggaaagcctttgtatgccaaagctttgtgtacccagtataaaaatctctgctccagaatggcttgatctccttggagatcaggcagaaaattctgtcttttgcttttctttgcaatacctggttgaaccactgacttaccgtacgttttaactttcctgatatcctaccattatgtgttactatcagc

SEQ ID NO: 68615 - DNA, 500 bp, Homo sapiens
tctttctttgaaaagataaatgacttgcaaaattatagaagacatccttttttacattagagggaaaggagatggacaaatgaatgaataaataaatcagaagcaattgatttttttctgcttgcttctacagcttattgcatgtgaatagccaaagcaattttcactgggctaaattctgagtctattttttaaatctctttcatctaaagaaaatagagtttactttagaaatgctgacacatgccagagtctgaaaagtgctagcatgtgttgctctgaagaaaagaagacatttttctacttttttttttttttttttaaattgctgttcttggacttgggatcctttctttcgatggtgggtaggactttcaataatccgttctgagaagctgctcttgttgtttgtgttatacacatctgttctcccagtcctgttgctgggactgtgagggttcctagcctggagggggttttggaagagttgagagggcaag

SEQ ID NO: 68616 - DNA, 362 bp, Homo sapiens
gtcagttaaatacattggtcatgtatccgattgtttttaatactaatttgaaatgcttcatttttaaatacccaatgtttatatgaatttgcattcacaataatgtttattctttcaattgatctatttctttttcagctctaagctgtctgggttaccatagcttcctaatttattttcataccttgataggttatcattctattctccctgtaatcctctggctatttacatgggtttatttttccagatgaacttgtcaatttgtcaagttccaataaggatgcattgatttcagttggtatttatttagaggtcaatttaggaaaaattaacctctttattttataattttcctattc

SEQ ID NO: 68617 - DNA, 425 bp, Homo sapiens
gtctttgggccctccaacgtggactcaccatgagaggacgatcgtgtgctattccattaaacatgcctccgtctcacgactccagccagggttaaaaccttcagatgttttctcaacacattaagcagaactaaccatcacaaaggcaaaaactaaacccatctgtccccttgtcaggatttttgagattgtcaatggactgaccttgtggctggaaaacattttggaggccgtgtaacaaaagttaaatgtggcagtgaatgcacagagaaattcttagaggtcactagtgaattactaacaccattaccctggcaagagatgatggagtttccattttatctcagaggtttggtgggtgtatggtgatgacttaaaatgacgttaggctacgtagccaacactttcttggaaaggactttccc

SEQ ID NO: 68618 - DNA, 876 bp, Homo sapiens
agaacctagagcccaaggttcagagtcacccatctcagcaagcccagaagtatctgcaatatctacgatggcctcgccctttgctttactgatggtcctggtggtgctcagctgcaagtcaagctgctctctgggctgtgatctccctgagacccacagcctggataacaggaggaccttgatgctcctggcacaaatgagcagaatctctccttcctcctgtctgatggacagacatgactttggatttccccaggaggagtttgatggcaaccagttccagaaggctccagccatctctgtcctccatgagctgatccagcagatcttcaacctctttaccacaaaagattcatctgctgcttgggatgaggacctcctagacaaattctgcaccgaactctaccagcagctgaatgacttggaagcctgtgtgatgcaggaggagagggtgggagaaactcccctgatgaatgcggactccatcttggctgtgaagaaatacttccgaagaatcactctctatctgacagagaagaaatacagcccttgtgcctgggaggttgtcagagcagaaatcatgagatccctctctttatcaacaaacttgcaagaaagattaaggaggaaggaataacatctggtccaacatgaaaacaattcttattgactcatacaccaggtcacgctttcatgaattctgtcatttcaaagactctcacccctgctataactatgaccatgctgataaactgatttatctatttaaatatttatttaactattcataagatttaaattatttttgttcatataacgtcatgtgcacctttacactgtggttagtgtaataaaacatgttccttatatttactc

SEQ ID NO: 68619 - DNA, 1234 bp, Homo sapiens
aggccgagatgtcggggagctgacaagatgccccagtgacatttcagctagaaagagcaagtgtcttgcaaccaagtggtcaaatatcaaataataggtcaagcaggaaggagctgagttctaaccacaaagaggtttctggtaacttacttgacaagcttttgggtgctttgtggcttgacaaagtgatgttctgttgggtatcgctagacagactgttctttatcgccttcagaagatcagacattgacattgattaaactctttaacccttaaaggttaaatccttgcagtttgcatcatggtaagtgaagaacaaaagaatatttgtagtaagaatttgtttttgtatttatcatttaactccctagtgctattaacttctgatgtgaactatagcttttgacaaagagtcttgatacataatctattttttatattatttttcattatggaatctttcattatggatacattagagtataacagtatgtattacagaagtttttttgtcttatctttacagtgacatttgattcaaatatacccaactgctgagaatttttttattggccttggtaaataagattttatactaactatttattagtagccaaattagccaagtgatttatgccatctgagggaacacagcagtattactgtcgtactgtgtaacacatcctattcttgtaatactgaaccactataattagctttatataaaactttagaaagcttatatggagtaaaattatatctttaaccaaatttctcttaattctttccttggaattatttttaatatgacctgtgtaacatgacctgtatgaaattcaacttgcaaatttattataacatggaagtgctatttattgtttttatacagatcatataatttctgcacatttcagaacacctttctctgctgttccaaacaatgattaggatattgttcatacagaaattgatagacaattttttagttcatgtgatatcactgagcttacaattctcactagagaagaacaaggttactatatgtaacctctatgtctaagtgtttgtgtgtgtgtatgcttgtgttgaatctgttttcagatcctactgattttagaggaacaagcagctttgtaaaatgtgccttggaaaggccttggtcttcttgccttgattttataatctgttaatgggataactccaaaaataaatgtgtatgtgtctccatataaaa

SEQ ID NO: 68620 - DNA, 397 bp, Homo sapiens
ccctccaagccatgtgctcccgcacatggtgtgccatttgttaagcccgttggaagagcgaataggaacagctccagtctacagctaccagcgtgagcgacgcagaagacgggtgatttctgcatttccaactgaggtaccgggttcatctcactggggagtgccggacagtgggtgcaggacagtgggtgaagtgcaccgtgcgtgagccgaagcagggcaaggcgtcgcctcacccaggaagtgcaaggggtcagggaattccctttcctagtcaaagaaaggggtgacagatgacacctggaaaatacagccatctgatatttactccccagtgtgacttggtttcttctacatgctgtcaggtacaaaataaaacaaaagatacattttagaa

SEQ ID NO: 68621 - DNA, 2965 bp, Homo sapiens
  misc_feature (488)..(488): n is a, c, g, or t
  misc_feature (541)..(541): n is a, c, g, or t
  misc_feature (754)..(754): n is a, c, g, or t
gagacggaattttgctctgttgcccaggcttcagtgcagtggcatgatctcggctcactgcaacctccgactcccaggttcaagtgattctcctgcctcagcctcaccagtagctgggactacaggcaggcacttccatgcctggctaatttttcaaatttttagtagagacagggtttcatcatgttagccaggatggtctcaaactcctgacctcatgatccacctgcctcagcctcccaaagggctgggattataggcatgagccactgtgcctggcctaagctctaattttttatcttgctgaaattcctatctaaggggcttagggagttatgccctacaaaccataaattctcatcagatgggttttatttaaccctgtatatcaagacttactttccaatcagactctggcataacaagaagaaaatcaaaatgttttacccaaaaatatatttccttgccataccttgaaattgccctgnaaagtctcttgtaggaaaaatccacattctataaagaaccccatttcctcttngttttctttccttccttcccagatccaggagacaatcaactaagagccacatacccttttaggtctaagacatattttacaacctgctctctctctgacgtctggtgtctgagagataccggtgcacaataaaacttggtctccacaaagctttaccttaacctgaacattccttgccattaatcccaggtcttcaaataaactcacccaatngtcagccacaaaatgtttaaatttacctatagcctggaagcccccactttaggttttcccacctttctgaaccaagccaacacagttcttaaatgtatttaattaatgtctcatgccttcctaaagtatataaaaccaagccgtaccccaaccaccttggccacatagtctcaggatttcctgagggctgtgtcacgggccaggttcactcatatttggctcagaataaatctcttcaaatattttacagagtttaactctttttgtcaacagcagcatctgctctgaggatgatggtgtatatttttcagtatctttatagtctcaagtgacagaaacccagtctcaggcaaaggagaatcttttggcttacagaatccagagaatattaacaagacaggggcagacatgcagaggaacaatttgaaccagggacttgaatgactgcaggattcttactccacctcatctcattgtttctgtacatcagtttcattctcgcctgtaggggggctgtctccacatgataggaatcataaccacaaacagcacacaaaatgtgcattccaccagagggagacagcctgatatatttaaatctgtttagaaacacacacacacacacacacacacacacacacacacattggagaggtattatgattggcccagcttaggttacaaagtcatgagaaatgactgctcaaccctggaccaatcaactttagtcatgggatgggatcatataaagatatcacagcttccatggcaacaacatgatttggcttggcagaaagggaagtttctaaagtaaagacactataaggtacagaactttccaaaaggcgagttgctctaccacaaaagggatgaccatatggcttccatcctgggctgacatcttagcaggttgaaggagaagacccctaggaacgcgcaccaaacccataatagtagctatataacctccccagcgttttctgccatgtggttcctcagctgggaagataaatccccaccaaaatcaatcaggggtgccttccaaattctggtgacctgaaacaaagctataactgtagcaattaaccaaaaacatgcacccaatttagggagaaagttttggatacacagccaatctattagccatctcttcccaaggcaggtggtgacttgagaactctgtgcctggtttctgaggactgtttcaccatgcagtggctaatgaggttccggaccctctggggcatccacaaatccttccacaacatccaccctgccccttcacagctgcgctgccggtctttatcagaatttggagccccaagatggaatgactatgaagtaccggaggaatttaactttgcaagttatgtactggactactgggctcaaaaggagaaggtaagagatctgccgtgatggcgatataagaacaagggtggcctcactttccttatcttgctcctactaggctgaaaggtatggaaccaaagttacttctgcctcaacttatcagtgttgtggaagaagcttatatttcaaggttctattcccagcctggccatttccttacttcattgagcctcagtggtttcatctatgaaatgaggaattaactcctttaaaaacaagaaaataggtaaatatatcttttattcaatcagggtactataattgtgaccaggtgcaaagttctagtcacaaggtcagcaaattcgtattagtctgagttctcatcttcagtgaatgggacaatgtgtcttaactggtattcatgtcatcaaacttgggcttgacttgagactgcatgcagaggaggggatagaccacctgaatgtgcacatgagtgtctgacacatttacctatgttaggccatccatcttcccatgaggatggcaagtctaattagattcctccttgtcaactacctacttgactgtggctttaaggtatgtcaagaaaaaccaagccctgtgtcttccagaggttatgtgtttctgcagaaaaccccaagtgcttggtttgtcttctcacaagacacagaccaagagagaagcagtagtgacattaggagtcaggtagacaatggatggtatttatagccactaactcccagctgccaatatggtagtgtaaaaagtcacccagcactgtctttgtacagaagagagaatccccctgagatggaattggagagttaatataatttt

SEQ ID NO: 68622 - DNA, 3948 bp, Homo sapiens
  misc_feature (488)..(488): n is a, c, g, or t
  misc_feature (541)..(541): n is a, c, g, or t
  misc_feature (754)..(754): n is a, c, g, or t
gagacggaattttgctctgttgcccaggcttcagtgcagtggcatgatctcggctcactgcaacctccgactcccaggttcaagtgattctcctgcctcagcctcaccagtagctgggactacaggcaggcacttccatgcctggctaatttttcaaatttttagtagagacagggtttcatcatgttagccaggatggtctcaaactcctgacctcatgatccacctgcctcagcctcccaaagggctgggattataggcatgagccactgtgcctggcctaagctctaattttttatcttgctgaaattcctatctaaggggcttagggagttatgccctacaaaccataaattctcatcagatgggttttatttaaccctgtatatcaagacttactttccaatcagactctggcataacaagaagaaaatcaaaatgttttacccaaaaatatatttccttgccataccttgaaattgccctgnaaagtctcttgtaggaaaaatccacattctataaagaaccccatttcctcttngttttctttccttccttcccagatccaggagacaatcaactaagagccacatacccttttaggtctaagacatattttacaacctgctctctctctgacgtctggtgtctgagagataccggtgcacaataaaacttggtctccacaaagctttaccttaacctgaacattccttgccattaatcccaggtcttcaaataaactcacccaatngtcagccacaaaatgtttaaatttacctatagcctggaagcccccactttaggttttcccacctttctgaaccaagccaacacagttcttaaatgtatttaattaatgtctcatgccttcctaaagtatataaaaccaagccgtaccccaaccaccttggccacatagtctcaggatttcctgagggctgtgtcacgggccaggttcactcatatttggctcagaataaatctcttcaaatattttacagagtttaactctttttgtcaacagcagcatctgctctgaggatgatggtgtatatttttcagtatctttatagtctcaagtgacagaaacccagtctcaggcaaaggagaatcttttggcttacagaatccagagaatattaacaagacaggggcagacatgcagaggaacaatttgaaccagggacttgaatgactgcaggattcttactccacctcatctcattgtttctgtacatcagtttcattctcgcctgtaggggggctgtctccacatgataggaatcataaccacaaacagcacacaaaatgtgcattccaccagagggagacagcctgatatatttaaatctgtttagaaacacacacacacacacacacacacacacacacacacattggagaggtattatgattggcccagcttaggttacaaagtcatgagaaatgactgctcaaccctggaccaatcaactttagtcatgggatgggatcatataaagatatcacagcttccatggcaacaacatgatttggcttggcagaaagggaagtttctaaagtaaagacactataaggtacagaactttccaaaaggcgagttgctctaccacaaaagggatgaccatatggcttccatcctgggctgacatcttagcaggttgaaggagaagacccctaggaacgcgcaccaaacccataatagtagctatataacctccccagcgttttctgccatgtggttcctcagctgggaagataaatccccaccaaaatcaatcaggggtgccttccaaattctggtgacctgaaacaaagctataactgtagcaattaaccaaaaacatgcacccaatttagggagaaagttttggatacacagccaatctattagccatctcttcccaaggcaggtggtgacttgagaactctgtgcctggtttctgaggactgtttcaccatgcagtggctaatgaggttccggaccctctggggcatccacaaatccttccacaacatccaccctgccccttcacagctgcgctgccggtctttatcagaatttggagccccaagatggaatgactatgaagtaccggaggaatttaactttgcaagttatgtactggactactgggctcaaaaggagaaggagggcaagagaggtccaaatccagctttttggtgggtgaatggccaaggggatgaagtaaagtggagcttcagagagatgggagacctaacccgccgtgtagccaacgtcttcacacagacctgtggcctacaacagggagaccatctggccttgatgctgcctcgagttcctgagtggtggctggtggctgtgggctgcatgcgaacagggatcatcttcattcctgcgaccatcctgttgaaggccaaagacattctctatcgactacagttgtctaaagccaagggcattgtgaccatagatgcccttgcctcagaggtggactccatagcttctcagtgcccctctctgaaaaccaagctcctggtgtctgatcacagccgtgaagggtggctggacttccgatcgctggttaaatcagcatccccagaacacacctgtgttaagtcaaagaccttggacccaatggtcatcttcttcaccagtgggaccacaggcttccccaagatggcaaaacactcccatgggttggccttacaaccctccttcccaggaagtaggaaattacggagcctgaagacatctgatgtctcctggtgcctgtcggactcaggatggattgtggctaccatttggaccctggtagaaccatggacagcgggttgtacagtctttatccaccatctgccacagtttgacaccaaggtcatcatacagacattgttgaaataccccattaaccacttttggggggtatcatctatatatcgaatgattctgcagcaggatttcaccagcatcaggttccctgccctggagcactgctatactggcggggaggtcgtgttgcccaaggatcaggaggagtggaaaagacggacgggccttctgctctacgagaactatgggcagtcggaaacgggactaatttgtgccacctactggggaatgaagatcaagccgggtttcatggggaaggccactccaccctatgacgtccaggtcattgatgacaagggcagcatcctgccacctaacacagaaggaaacattggcatcagaatcaaacctgtcaggcctgtgagcctcttcatgtgctatgagggtgacccagagaagacagctaaagtggaatgtggggacttctacaacactggggacagaggaaagatggatgaagagggctacatttgtttcctggggaggagtgatgacatcattaatgcctctgggtatcgcatcgggcctgcagaggttgaaagcgctttggtggagcacccagcggtggcggagtcagccgtggtgggcagcccagacccgattcgaggggaggtggtgaaggcctttattgtcctgaccccacagttcctgtcccatgacaaggatcagctgaccaaggaactgcagcagcatgtcaagtcagtgacagccccatacaagtacccaaggaaggtggagtttgtctcagagctgccaaaaaccatcactggcaagattgaacggaaggaacttcggaaaaaggagactggtcagatgtaatcggcagtgaactcagaacgcactgcacacctaaggcaaatccctggccactttagtctccccactatggtgaggacgagggtggggcattgagagtgttgatttgggaaagtatcaggagtgccatgattccaatgttttccttcttttaaattaaattcagttgctctgcttcctccaagtcctctgtatctttagaatttcccaggtgagcactcataacgcaagtaataaaatactgatatcaacaa

SEQ ID NO: 68623 - DNA, 1169 bp, Homo sapiens
ctcagttgaaaactgcattattgtgagcatgaacaccgctgaccctggcagccagggcatcacacacagtaggtaggaaagaatacctagaggctgcactgggagccctctctagcaagtggtgcttttcattttttttgatcactgttttccaacttgaagacacattggtgacatctactaactcatgaaacatagacccttggcttgagtttcacatttgcgtattttaaaggcttttgacagttttattccattttctgatgtttcctctgttatttcatccacactggtgtcccatgcataaaccagacagtgcttgggtggggcagaagggctgcggcctcctgcagtgtatgattcacaggcctcttgctacaggtcattgatgacaagggcagcatcctgccacctaacacagaaggaaacattggcatcagaatcaaacctgtcaggcctgtgagcctcttcatgtgctatgagggtgacccagagaagacagctaaagtggaatgtggggacttctacaacactggggacagaggaaagatggatgaagagggctacatttgtttcctggggaggagtgatgacatcattaatgcctctgggtatcgcatcgggcctgcagaggttgaaagcgctttggtggagcacccagcggtggcggagtcagccgtggtgggcagcccagacccgattcgaggggaggtggtgaaggcctttattgtcctgaccccacagttcctgtcccatgacaaggatcagctgaccaaggaactgcagcagcatgtcaagtcagtgacagccccatacaagtacccaaggaaggtggagtttgtctcagagctgccaaaaaccatcactggcaagattgaacggaaggaacttcggaaaaaggagactggtcagatgtaatcggcagtgaactcagaacgcactgcacacctaaggcaaatccctggccactttagtctccccactatggtgaggacgagggtggggcattgagagtgttgatttgggaaagtatcaggagtgccatgattccaatgttttccttcttttaaattaaattcagttgctctgcttcctccaagtcctctgtatctttagaatttcccaggtgagcactcataacgcaagtaataaaatactgatatcaacaa

SEQ ID NO: 68624 - DNA, 1002 bp, Homo sapiens
ctcagttgaaaactgcattattgtgagcatgaacaccgctgaccctggcagccagggcatcacacacagtaggtaggaaagaatacctagaggctgcactgggagccctctctagcaagtggtgcttttcattttttttgatcactgttttccaacttgaagacacattggtgacatctactaactcatgaaacatagacccttggcttgagtttcacatttgcgtattttaaaggcttttgacagttttattccattttctgatgtttcctctgttatttcatccacactggtgtcccatgcataaaccagacagtgcttgggtggggcagaagggctgcggcctcctgcagtgtatgattcacaggcctcttgctacaggtcattgatgacaagggcagcatcctgccacctaacacagaaggaaacattggcatcagaatcaaacctgtcaggcctgtgagcctcttcatgtgctatgagggtgacccagagaagacagctaaagtggaatgtggggacttctacaacactggggacagaggtggtgaaggcctttattgtcctgaccccacagttcctgtcccatgacaaggatcagctgaccaaggaactgcagcagcatgtcaagtcagtgacagccccatacaagtacccaaggaaggtggagtttgtctcagagctgccaaaaaccatcactggcaagattgaacggaaggaacttcggaaaaaggagactggtcagatgtaatcggcagtgaactcagaacgcactgcacacctaaggcaaatccctggccactttagtctccccactatggtgaggacgagggtggggcattgagagtgttgatttgggaaagtatcaggagtgccatgattccaatgttttccttcttttaaattaaattcagttgctctgcttcctccaagtcctctgtatctttagaatttcccaggtgagcactcataacgcaagtaataaaatactgatatcaacaa

SEQ ID NO: 68625 - DNA, 527 bp, Homo sapiens
gcaaatcccatgggtacatccaccttctaggggccagggggagaacctgaaatacttggggactccattaaggccaccatatggtgtcagcctgcatgggagactgtggaggggcagaggaggagagtggagaattgttaggaaatggcagcaggactcaatcactgtggatttgctttatcctcaaccaggtggagtttgtctcagagctgccaaaaaccatcactggcaagattgaacggaaggaacttcggaaaaaggagactggtcagatgtaatcggcagtgaactcagaacgcactgcacacctaaggcaaatccctggccactttagtctccccactatggtgaggacgagggtggggcattgagagtgttgatttgggaaagtatcaggagtgccatgattccaatgttttccttcttttaaattaaattcagttgctctgcttcctccaagtcctctgtatctttagaatttcccaggtgagcactcataacgcaagtaataaaatactgatatcaac

SEQ ID NO: 68626 - DNA, 400 bp, Homo sapiens
agtggcagttggcataattggattcagataaacatgtatattattgttttctatttgttgttcttctctgtgttttttaacttctcttttctgccctttttccttttagctgagcattctatatgattttattttctatattatatatctatatagtctactttttcttagattctattagtgagttccccagagtttgtagtatagcattcacaactaatgggccttcaatttcaaatagtactatactggcttcaggaatagtgctggtataatagacagttccgaagtgtgatagactgttcttcctcccatcacatataacattactttcattcattagttcaactgggagctataaactactgaatacattgttgatattattattttttctttt

SEQ ID NO: 68627 - DNA, 268 bp, Homo sapiens
cttgtagttgatatttactgattgaaatgtatatacacaaaaattatgtaaaactgattatctagaggtttcttcattagctagcacaaatagttattgtaaacctttgtcctgtatttttttaaagtctgcaacatggtgaaccagtatgcttgatggctttaatacctgtgtctgcaatttattattcatttgaagcaacaaattcagaattgtttgaaattatgaaggctaaacagcataaatacattgtggtttcttttataaa

SEQ ID NO: 68628 - DNA, 362 bp, Homo sapiens
gtgaggaaagagtcttctcttgaccagaaaatgatacctgtggtgtcttttcctgaaactgaaaacattaaagcattctgatcccagagaaaacaaattctctgggatataagggttcaccttttggaggtggattacacttttcaggacaccagagaaccatagagcaaattacttcttccagagtgctaaatgatcccctggtgccctggaaagagaccgtttacctccaaaaggtgagttgtttattgccagagagtagaatattggctgtaatgcctgctcatccatccttctccatccctgcgaggtatttagggtggaggagatattatccacctgtcaccatggggaaggagact

SEQ ID NO: 68629 - DNA, 591 bp, Homo sapiens
actggacgcggtaactgtcctcttgagagccatcttgcctagctgggccaagccgagatagcacactcaacgcccagcatgccgaggaggaggagacgccgagggtcctccggtgctggcggccgggggcggacctgctctcgcaccgtccgagcggagctttcgttttcagtgagccaggtggagcgcagtctacgggagggccactacgctcagcgcctgagtcgcacggcgccggtctacctcgctgcggttattgagtacctgacggccaaggtcctggagctggcgggcaacgaggcccagaacagcggagagcggaacatcactcccctgctgctggacatggtggttcacaacgacaggctactgagcacccttttcaacacgaccaccatctctcaagtggcccctggcgaggactagcttctgacacccggcccctgggacctgacaggtccactcgtccacccacccggccccaaatcccccggcctgaacccccggccttaaacaccctccccccacaacccaggccccaaagtcttgggccttcattaattctgtcaataaaatgtttcaaggaagcca

SEQ ID NO: 68630 - DNA, 1367 bp, Homo sapiens
ttcttctcagggaacccagacatccatccctcaagattccagtccttgtcctagtccggcccttgacctcagagacgggatcagctcttcctccagcacctaccttgagggtatagaagaatgcaaaccacattggaaacctggagatctgtgttctcatttcagctctgctgactggcttcctgcaagctaccttccctccctgggcctcagtttctctctctgctgagccagaagatgtctaaagacccctttggttccaccctgagagcctgtctccctaacctcaacttcttccccagttcagagaacccaggcatccagctgccccaccccagctctgggtaaacaggaagctgggtgaggggagcaggggtgtgcggaaagtcccagccaggtgtgcaggtctacagggagggggtgggcccgtccctgaggtatgaaagccccctgctctggctctggttcagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactggtaacggagacggccgaccccggggcacaggcccagcaaggactggggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaagatgct

SEQ ID NO: 68631 - DNA, 617 bp, Homo sapiens
  misc_feature (3)..(3): n is a, c, g, or t
  misc_feature (36)..(36): n is a, c, g, or t
  misc_feature (38)..(38): n is a, c, g, or t
  misc_feature (100)..(100): n is a, c, g, or t
  misc_feature (108)..(110): n is a, c, g, or t
  misc_feature (112)..(112): n is a, c, g, or t
  misc_feature (136)..(137): n is a, c, g, or t
  misc_feature (163)..(163): n is a, c, g, or t
  misc_feature (179)..(179): n is a, c, g, or t
  misc_feature (297)..(297): n is a, c, g, or t
  misc_feature (312)..(312): n is a, c, g, or t
aangaagaaagggagaaaaggatagaagcatttttngntgctctctcttcccctggtggtgttgtggtggtgttggtgtaaaaaaaaaaaaaaaaaaaanctcccccnnntnttcttctctgtgtggctcaagtannctggtgtgatcccctggcctactcgnggcagtatcaggtcanaatgatgctgggcaaatgcctttctgaatgaattgtatatcagaggggttccacggggtgtccactctttttaatgtgaggacattttttgcttatctgtgatggtggatatcatganaaattatgcacaacnccttttttcttaaatagctcatcagctatcgttagtgtattttatgcatagctcaggacaatttttcttctttcagtgtggcccagggaagccaaaaggttggaacccagaattctagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaagatgct

SEQ ID NO: 68632 - DNA, 1321 bp, Homo sapiens
ttcttctcagggaacccagacatccatccctcaagattccagtccttgtcctagtccggcccttgacctcagagacgggatcagctcttcctccagcacctaccttgagggtatagaagaatgcaaaccacattggaaacctggagatctgtgttctcatttcagctctgctgactggcttcctgcaagctaccttccctccctgggcctcagtttctctctctgctgagccagaagatgtctaaagacccctttggttccaccctgagagcctgtctccctaacctcaacttcttccccagttcagagaacccaggcatccagctgccccaccccagctctgggtaaacaggaagctgggtgaggggagcaggggtgtgcggaaagtcccagccaggtgtgcaggtctacagggagggggtgggcccgtccctgaggtatgaaagccccctgctctggctctggttcagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactgggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaagatgct

SEQ ID NO: 68633 - DNA, 1946 bp, Homo sapiens
ttcttctcagggaacccagacatccatccctcaagattccagtccttgtcctagtccggcccttgacctcagagacgggatcagctcttcctccagcacctaccttgagggtatagaagaatgcaaaccacattggaaacctggagatctgtgttctcatttcagctctgctgactggcttcctgcaagctaccttccctccctgggcctcagtttctctctctgctgagccagaagatgtctaaagacccctttggttccaccctgagagcctgtctccctaacctcaacttcttccccagttcagagaacccaggcatccagctgccccaccccagctctgggtaaacaggaagctgggtgaggggagcaggggtgtgcggaaagtcccagccaggtgtgcaggtctacagggagggggtgggcccgtccctgaggtatgaaagccccctgctctggctctggttcagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactggtgagtggctgcaacaggccctggtggagagttgtatcttgcggatgcttggctccctctggttgtgcctgtggtcttttgccccctctggctcagctggctcggctgtccctggtggggatgtcttgtctctttgctgactctctttccatgttcctgtgatgttgtgcttgtgtcccgacataagccccttgtgtctcctctcctcttcccgaggtacatctgtttctccgcccaagtacctatgccttgcttgttctcccttctaaggaggtgtgtgttggggatggtgctggtaggagaaaccccaggcctgcagcttgggtccactttcagaggggtaggggtgacatgagctgaatctgaactctgggcactgtgaccccacccaaccaggtaacggagacggccgaccccggggcacaggcccagcaaggactgggtaagagcagactgtctctccttccccgcttcagaccctcaggggctcccagctccctgctgcgtccccagatacctcttcctctaggaatccaggctccccatccctgcgccctgttctctcaagggtagcctgcatgggtggctgccctgcccccaatcgtggactctttgccccttccagggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaagatgct

SEQ ID NO: 68634 - DNA, 412 bp, Homo sapiens
tgcaaccttaagttagacaaagagttcttaaacacaacagcaacagcataatccatgaaaggaaaaactgaaaaaattgacttcatcaaaattaaaaacttttgtgcttcaagaaacatcagtaagaaaatgaaaagcaagccacagtctgggagaaaatatacacaaatactatttctggtaaaggatttgtatccagaatatataaaaatcacttgtaagttaataataagacaagccaattaaaaatgggcaacagttgaataggtatttcaccaaagaaatatgaatggctaataagcatttgaaaaggtgctcaacatcattagtcgtgaggtaaatgaaaattaaaactacaaggagatgctattatacttcgtgcccagtagaaggaatataataaaaagacaaa

SEQ ID NO: 68635 - DNA, 416 bp, Homo sapiens
tcggaatcttcattgtttaggcaggaatttgaggagcagatgttatgccccttgaacaggccctttaattcgccttagtactgtgtctaatgactcttaatcctgtccttttaactctgtggctagcagatttcggagtgaagtgagacaggaatgatgagcttgaagctgaacatttcattttaatgttggcaaagtagtctacagatagtacatgacaaacagtgagacagagggaacatgttaaaagtgttcctatatagcagaaaaacaatgtgaacattagtgtgggatcactgaaattttgggtttcccgtcaaatgtagatagaacagtttggttgattagtttgccagagaaatggagccattgactgtttctactttgtcttcttaaacttttatattttttagatt

SEQ ID NO: 68636 - DNA, 2913 bp, Homo sapiens
  misc_feature (729)..(729): n is a, c, g, or t
  misc_feature (1176)..(1176): n is a, c, g, or t
  misc_feature (2830)..(2830): n is a, c, g, or t
tcacttacccattccataattagtttccttgtatgtaaaatcaggggataataatgtcaacaaatagttatctgcttaacattgttttattaaaaagcaggtatgttcgcatgaataaaacaaccttcccttttaaactccttgtttggcatcctcaaacctctcagcttgtttcagatgggaacttcaacccaatatcaggtcacagtgcccaggttgatctgtactccgtgtgggctctgaaagcatcacccctgcagaggctggaagccctagtcttcccaggggatgccttgtctgcaggtactgcccccagcctgcagtgaactctggaccttttattgatcctgtgtgcatctggctccactctgataccaggaagaatgggggttgctggccctggacttggtcctggacaaataaatgtgtttgtcaaagccctttcctgacatcggttgtctctagcccaggtggcactgtggagggtaattagttctctttattagagggaacatcaggaagctctgcgctgctcaccgtggacacatgtaaaaagattttgttaatgcagctgttacttgccttttcattatgctaatgggcagcctgtaagaaatgtaacttcctgtcactggcaccaagcaacacctatcagacaaagcattgtttcttctcactgttgataagtgtgacttgtggggaccagcgataggatgctcatttttatcngctaagtgcacagcgcttgtaaaaaaccagcagtggccttgttaccacttgacgtgacactaggtttagctgtttacattgacacactgctgcacccttttagagctgcagccaggggtcagattcattagaaagcgtcagcgccgatagtgaagcagcatctggtgggattctctctgctctcctgttggaagcagcaaggcaaggcgcttgcatcttgaaatgggtgatttttaaatcttttcttcgtttgattatttgagaacccctgtttgttccttgaccctacatgaagaagatgagagagaaagagctggacatagcattcaccccagtgatgaagaatgggaatgttggggcctgctgtttgttgcttttctttttgctgatgtgtggctcttcgttgcccaaaaggtctgcagagagggagttaaatgcatgtgtttntcttgcacagcagcaaggctaaaatgtggaagtaagctaagtaaacctttataattagtcctttatgtctttctccttttgcctccctatgtatgagtattgccttgataaatttggtgaccatacttcccttataatgctggaagccacatatcttttggttctatgttgttatccctttagtcatttaggatatggaggatgatcacccagaatccttggttcattttgcaatcactgtgaccagatgagttgctgataacctagagcagccagagtgcttgttgcattaagagccagagcccaggccttcacttttgccacatgtgactctatgtccatgaaactatgtgcaggacaatgcacacggcaattgagaaggttctggagacctttcataatgttgtgtgagggctcgctggccaccatggcagagagagcaacatcctccttaccttcagaaacctctggcaccaccagcattgctgacatatctcacgccctgtcacagcttcttagttcaacaggctgcaaaagctcctccccacctccacctgttcataaggatgtaaggataattagtgcattttctcaagttcaatgatacactcattttgaaaagcaactaccgcattatcctgcccttgcccttgggaactggatcccttcatttgtcgagaataccccttgccaggccttttcatctagccgctgctcacactgcaccggggcttctgtctgggtgattcttgctgggtcatgccaggaggtatttggcatttccctaaagcccatcatgtgaagtaagagtaccaccgaatcacgaagctctgagaagttttgttaagatcagtcatggcttgatcagtccaagcattaggatacctagtttgcaagtccagtgttgtccacctggcctggaatttaccaactgctctgtggagagctctcatcccacttatgaactgtgctgcttatctgcactttctttttctgtatgcccagtacgtagctatgaagggaggatcccaggggccagaagccaggggaccatgtagtgtcttagtgtggtttatatgtcattgcagtctccatccaggtcttttccagatcctgggatgctgccaagaatttccatgcacaggaagacagagatggtcatggtgatatacagacttatacagaagacgtttttctatctttggggggcttttgacccctttccactcacttgaattcacacagaataattatatgctcttctgagggcttactgctgggtcagaaaagcagggagagttgcttttggatagtaatccccactgctggccaccagcagctgcagcctccacagcagctgcttcccctcgcctccatgccaccatctccccttcatatccactatctccttgtctctctgcaggtcatttataatcagcagtcatggcgtacaggcctcattagtgatatagccattccttcagtgcttcagaaataatcatttagaaaaaaatgcacggtttccatcccttgagagcccatgagtgatgaatttatttcagtttggctggcttggctgtcttgctcagccttatttccatatttatttcaacaaacaatgtagggtgggaacaagaaaacacatgctgggtgnacacacacgctgcatatctgctccctaagttgattcctcttggggaaggatgaaaaggaatgccaacgaaagaaccctccatt

SEQ ID NO: 68637 - DNA, 210 bp, Homo sapiens
gcttctgttaattcatcaaataattccttaggctaataaaacagttatagttcaagacatttgcaccccaacaaaggagtacaaagattgaatgaaatataataatactgaagaattattatgaagaaaattattttctggactaaatgctattaagtcaatttaattccttgatctattttctgtatactacatataaattgattctaa

SEQ ID NO: 68638 - DNA, 485 bp, Homo sapiens
ttcatttaaaattatcttattactgcttcccaggttgctatgatccgaaaccattgcttacattgagtaaccttttccatgtttatctcagtatgctgtgcccctcacccctgagccctggtgtatttcagcacaaagccaagatgtattgttgaaacccagggtccaggaagacagccacttagcaaatgggtgggaggattctaacacagatgcctgctacctgctgctcgtgctattgtgcttatttcacaggtgaattctgactgtttaagaagcacttttattgctactcattgtactcaagcttcagaaaattgtaatggagatttagatttagtaaacaagattcagtgaaaaattttagacatattaaaagtttaatcacaggattatttatcgagaccataatccccatggaatgggcctcggtattaaaaagttaaaatgctaaattatattattaaaattatttttctcttttt

SEQ ID NO: 68639 - DNA, 518 bp, Homo sapiens
atcttcaaaaacgttatcttatctctggcacactctggccttaacccggagtccgatgtctctgggataatgatggtgaatgctcatgagatccagaaagcaatatgttaaccatacagtgttcaaaaccgttcatcagatggagacactggtatgtgcatattccgcggcacagcagcagaaaggatggcgggcctttatgttgtctgataatgcagctctttgaaacattgctggcggactctcttcacatcatgtcacacaggacaagaaacgggacaggccctctctgcttctcaattcatcgacctgccatacaatacaacaaaccagctttttcaaggccccctgaatgaaggcctgtgcctgcaagggaaatttaattggatttctttatgggttgcaacaatccaatgaaaaattatgtaagaatggcatgattcagtttcagcatgcacttgaataataataatttttttatttataacaagaattctttaaaaaaataataagaattt

SEQ ID NO: 68640 - DNA, 553 bp, Homo sapiens
aggctccacacctagtacatcattgaaatcccttacttaccaaggctttcaccaaaagtaaaagttgctaagagttaacattgtaatatgtaattgagactgctgaaaaaataggtttagattcaagatgtgtaaggagaatgaaatgtgttttttataagagattatatgaaggtatgagaatgtaaattttttgcctaggttagagggttaaaggattgttttaaattaaataaagctaaaggttagaacaagttgtggaaagtttatgaaaaattgattgtaagagattctatgtgtgaacaaattggctaaagttaaaatggcattattcagttttttctataaattggacattggaataaaagcacaacagagttttcttagaacgttgttctgctctgagaaaaaaaaattgtaaagggttgtaaaaggcttataaaaattttactttatggtcaaattagttaaaactgaatagatttataagatgttattaaaaactagctttagcattaaaaatacactaataaaaacataaaatttggatttt

SEQ ID NO: 68641 - DNA, 2695 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68642 - DNA, 2108 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagca

SEQ ID NO: 68643 - DNA, 1140 bp, Homo sapiens
  misc_feature (18)..(18): n is a, c, g, or t
aaggctaggtacgaggcnggtgtgaatcgataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctcaaaaaaaaaaaaaaaaaaaaaaaaaaaaaaaaaaggggggggggggcaaaaagaaaatcccgggggggggccaattgggggaccccgtttttttgaaaagggggggggccaatgggggggggataaaaagaagggaggggggggggaaaacacggggggggggggacaaccgcgccggggccttgggggaagacccctcctgggggggccaattggggccaccccaagaagatagagccgggaaaaacctggtgtaaggggacccaggatgcggggggaatttgccctttctaatagcggcgcacactcaaagagaagcgagagaaacaagaagagaacaagcaagggacgcaaatgtaaaggaggaacagaaagaaaaaagctactaggcacgacatactacgcc

SEQ ID NO: 68644 - DNA, 782 bp, Homo sapiens
  misc_feature (18)..(18): n is a, c, g, or t
aaggctaggtacgaggcnggtgtgaatcggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgaggggggccatggcttgggctggggggggcccgggcgggcgggggaggcgggggacccttaaaacccggtgggggcgc

SEQ ID NO: 68645 - DNA, 581 bp, Homo sapiens
gcggccgcctactactactaaattcgcggccgcgtcgacagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaaaaaaaagaaaaaagatcaggaataataacatagtcttatggtgaactttggtgttctcccactaagctacatggcctcccttatcactgaatactgctaaaaaaacactggctaagtactgggtgatggactataggcaaccatcaggcaattcaagcagatgcttcttaacccttctgcaggctataaacggtacttcctgctgtctcataccagttcccctggagatccaggtataggggacatatgtagg

SEQ ID NO: 68646 - DNA, 528 bp, Homo sapiens
  misc_feature (234)..(234): n is a, c, g, or t
  misc_feature (236)..(236): n is a, c, g, or t
ctattttgggagttaaaattccttgaagacccagcatctgtcgttcttgtaaaagtaaaatccaattcccttgttttgttcttgggttcagcataagtggcttgcctttttcttttatgtgccaatgctgccattgccaccatcaagacccagcgtaccgtccagtttgtggattggtgcccaactggcttcaaggttggcatcaactaccagcctcccactgtggtgcctggngnagacctggccaaggtacagagagctgtgtgcatgctgaaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagtaaaccgtcgattcgacgggatcctctagatcta

SEQ ID NO: 68647 - DNA, 3101 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctcaaaaaaaaaaaaaaaaaaaaaaaaaaaaaaaaaaggggggggggggcaaaaagaaaatcccgggggggggccaattgggggaccccgtttttttgaaaagggggggggccaatgggggggggataaaaagaagggaggggggggggaaaacacggggggggggggacaaccgcgccggggccttgggggaagacccctcctgggggggccaattggggccaccccaagaagatagagccgggaaaaacctggtgtaaggggacccaggatgcggggggaatttgccctttctaatagcggcgcacactcaaagagaagcgagagaaacaagaagagaacaagcaagggacgcaaatgtaaaggaggaacagaaagaaaaaagctactaggcacgacatactacgcc

SEQ ID NO: 68648 - DNA, 2762 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctcaaaaaaaagataagagtcgccgagctaatccgtgagagggtatttatcggccggcggcggttcacgg

SEQ ID NO: 68649 - DNA, 2673 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttaggctgtgttttgggatgtcagcagtggcctgaagtgagttgtgcaataaatgttaagttgaaacctc

SEQ ID NO: 68650 - DNA, 2748 bp, Homo sapiens
  misc_feature (1313)..(1313): n is a, c, g, or t
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgagtcctgcatgtcccaagcagtcaggactttgtatattgagtagtacactttnggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68651 - DNA, 2540 bp, Homo sapiens
atactaaattagtcgaccacgctgtacggctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68652 - DNA, 2651 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagagtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68653 - DNA, 1874 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcacctgtgaattggccaccaacattctcctggttgctgagatcacacccctgggtgacagagggagactccttctcgaaaaaccccaaaccctctcttttcctgcctataatttaatcactgtagaaatctgtagaaaatactgaagtgtcaacgt

SEQ ID NO: 68654 - DNA, 2470 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagagtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaaaaaaaaaaaaaaaaaaaaaaaaaaaaaaaaaaggggggggggggcaaaaagaaaatcccgggggggggccaattgggggaccccgtttttttgaaaagggggggggccaatgggggggggataaaaagaagggaggggggggggaaaacacggggggggggggacaaccgcgccggggccttgggggaagacccctcctgggggggccaattggggccaccccaagaagatagagccgggaaaaacctggtgtaaggggacccaggatgcggggggaatttgccctttctaatagcggcgcacactcaaagagaagcgagagaaacaagaagagaacaagcaagggacgcaaatgtaaaggaggaacagaaagaaaaaagctactaggcacgacatactacgcc

SEQ ID NO: 68655 - DNA, 1753 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggtgtgcatgcttttaacagtcaatcttccaaaagattcagctgatcaaacctttctgataatgtaggatttattcataaagtggattttggataagcaagtttgatcagttttctttctgactctagaacaggtattcctcatcatccagatatatttggtttctctgggaagcctgaatagctgacattgcagatggcaagagataacct

SEQ ID NO: 68656 - DNA, 2165 bp, Homo sapiens
ggaggcgatctagaggtccctgaacgtgtcatatgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68657 - DNA, 2163 bp, Homo sapiens
aggctaggagaggccgggggtaatcggcgagtgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68658 - DNA, 1483 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggtatccgagtaatttgacttttactcattttgcaagtgaattgggattatttctttttccttatactttatttttgggtttttcaactgtatagttaattggcattaactatattcacattgtgcaccccgtcagcactgtccatctctaggacttttttcatcatcacaaactgaaactgtatacccattaaatagttactccccatttctccctcccccttgccccttgtaaacattattttactttttgtttctgaattcaatatacttttttccaaagagctccccacaataaaaagcttttttaaaaatttttta

SEQ ID NO: 68659 - DNA, 1106 bp, Homo sapiens
  misc_feature (964)..(965): n is a, c, g, or t
  misc_feature (987)..(987): n is a, c, g, or t
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaaccgaagtgaattctggttttttaccagagtgcgagagagagaaanngtgaagtggaaaaaatctgagntggttaaaattggatgaaggaagctgggagacaataggttgtggtaccaaggatggccttcttaggtaaaaaggatgtggggaaggaaataggactttggggattgaaaagtggagaga

SEQ ID NO: 68660 - DNA, 1579 bp, Homo sapiens
atgatggaacgttggacttatcctttgaattgaaagtgttttgtaatgaggaagctttctgtattataataaagatcaggtttgagcagttacctgtaattcagtgagactgtaatctaatgtgagcatttctctcataactttactctgaggtctagaccttgtttttgcagatctgcaggcttggtctagaggtgggatgtttatattaaagccctagcttttgaaagcccaaaatgaaaagtgcctgggagaaatgtgtcggtggcatcgataaacaccggtgtttatcgctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68661 - DNA, 1207 bp, Homo sapiens
taactaacagttattagttcctgttttctcaagaattaaatttgtttactttaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68662 - DNA, 1329 bp, Homo sapiens
  misc_feature (11)..(11): n is a, c, g, or t
  misc_feature (21)..(21): n is a, c, g, or t
  misc_feature (26)..(26): n is a, c, g, or t
  misc_feature (29)..(29): n is a, c, g, or t
  misc_feature (64)..(64): n is a, c, g, or t
  misc_feature (83)..(83): n is a, c, g, or t
  misc_feature (86)..(86): n is a, c, g, or t
  misc_feature (100)..(100): n is a, c, g, or t
  misc_feature (139)..(139): n is a, c, g, or t
  misc_feature (156)..(156): n is a, c, g, or t
  misc_feature (190)..(190): n is a, c, g, or t
gaggatataantactcgattntctantgntgtgtaatactttttgacaattgtgcttgtctgtnactgaaatgttatagaatnttnacactatagggatnatagagttatattagctctcctcaagagactgaagcacnatatttttcatgtaacnattcttatccaagtgctgctaatctgaagtgtcnacgtacgttgacacttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68663 - DNA, 1122 bp, Homo sapiens
ccgggctcgcaggaattcggcacgagagacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68664 - DNA, 1952 bp, Homo sapiens
actctagaggactcccccaagagttacattcagaatcaggtcagcttgtgggtgtggacctgaacacaggtaagagaatgcaactgttgtagagggaaaactagatgtaatacgtgtgagttgaagccaggaaagattaaaaatgttttgctttgcaatttgacaccagtgctgttagggaactctgggttctaaaatgggataaaataggatattaataaaaaatggaatgactaggtataattaagggacgagtagacatgagtaattgggggatacaattttggagatgttgagtggtggtagatggttcagattaatgttgaaggattttcatattgcatttgccttactcagtttttaatcaagtactatgataagaaaatagatgtggtgattatattcatgggtgaaaaccagctaaagatagcaattaatgccagaaaaggggatgtagaaatctagtgaaatggtgacagccctgatcttaggttcctgtaacaaaacaacacaaattaagtacaaagtaggagataacaggtacctccatgcagtatgtgcaagacctattgtcaacattaatagaaaaggtttctggaatgagggaaatgatcagtccattttagtcagattatagttgaagtgctatacttcagtatgagtaaacagaaatgtatccagaagaagagaggggtgttcaggacttctaagtataagtcagacattcatcaaatattgtggacgggggtcatggtttagagtagaaaattgggctaacagagaagctttgaattctcatagttaatactggaggaaatgagtcatcagtgataagcaaagctgcacacaatattgttggttcttactgactgaacttattttaagatttggttgccttttaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68665 - DNA, 1275 bp, Homo sapiens
  misc_feature (234)..(234): n is a, c, g, or t
  misc_feature (236)..(236): n is a, c, g, or t
ctattttgggagttaaaattccttgaagacccagcatctgtcgttcttgtaaaagtaaaatccaattcccttgttttgttcttgggttcagcataagtggcttgcctttttcttttatgtgccaatgctgccattgccaccatcaagacccagcgtaccgtccagtttgtggattggtgcccaactggcttcaaggttggcatcaactaccagcctcccactgtggtgcctggngnagacctggccaaggtacagagagctgtgtgcatgctgaaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68666 - DNA, 468 bp, Homo sapiens
agagtagcgaaatgagtctggatgagattgagcaggtgatcctggtgggtggggcactcgggtccccagagttcaggaggtgctgctgaaggccgtgggaaggaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68667 - DNA, 739 bp, Homo sapiens
tgttagataagcatatgttacttaccttgttattaaatatggaattttatgtcactgctgctaaagcaaaacatcctgttcactggataaaagaccttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttaggctgtgttttgggatgtcagcagtggcctgaagtgagttgtgcaataaatgttaagttgaaacctc

SEQ ID NO: 68668 - DNA, 999 bp, Homo sapiens
  misc_feature (857)..(858): n is a, c, g, or t
  misc_feature (880)..(880): n is a, c, g, or t
taggctagtagaggccgcggtttaatcggcagagccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaaccgaagtgaattctggttttttaccagagtgcgagagagagaaanngtgaagtggaaaaaatctgagntggttaaaattggatgaaggaagctgggagacaataggttgtggtaccaaggatggccttcttaggtaaaaaggatgtggggaaggaaataggactttggggattgaaaagtggagaga

SEQ ID NO: 68669 - DNA, 840 bp, Homo sapiens
aacttcggctaggtagcgaggcctgggtggctggctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagctttaatcagagggcttggtttggccacggagcacgggatccgggttttgagaacaagggctgaggggggaaaatcctcacgtggaacgggtctaagtttggaaaccgaagagaacctggtcttaaaacggggaacaagaaaaaacgcgggagggaaaaacttgcgaggttaaaatagaag

SEQ ID NO: 68670 - DNA, 2618 bp, Homo sapiens
gaacggctagtgagcctccggtaaatcggacgagggaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68671 - DNA, 2673 bp, Homo sapiens
gcgacgtaactcctaaacgcgttcataaacggtcagcagagggccctggcggtggccgcacactatccgcggcaccgacgggccgagactaacgttcccctcacgcaggacgctaaccgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68672 - DNA, 2145 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaggccacgaaggccggccttcgtggcctcgaggaattc

SEQ ID NO: 68673 - DNA, 2514 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaaaaaaaaaaaaaaaaaaaaaaaaaaaaaaaaaaggggggggggggcaaaaagaaaatcccgggggggggccaattgggggaccccgtttttttgaaaagggggggggccaatgggggggggataaaaagaagggaggggggggggaaaacacggggggggggggacaaccgcgccggggccttgggggaagacccctcctgggggggccaattggggccaccccaagaagatagagccgggaaaaacctggtgtaaggggacccaggatgcggggggaatttgccctttctaatagcggcgcacactcaaagagaagcgagagaaacaagaagagaacaagcaagggacgcaaatgtaaaggaggaacagaaagaaaaaagctactaggcacgacatactacgcc

SEQ ID NO: 68674 - DNA, 3528 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtaagagaatgcaactgttgtagagggaaaactagatgtaatacgtgtgagttgaagccaggaaagattaaaaatgttttgctttgcaatttgacaccagtgctgttagggaactctgggttctaaaatgggataaaataggatattaataaaaaatggaatgactaggtataattaagggacgagtagacatgagtaattgggggatacaattttggagatgttgagtggtggtagatggttcagattaatgttgaaggattttcatattgcatttgccttactcagtttttaatcaagtactatgataagaaaatagatgtggtgattatattcatgggtgaaaaccagctaaagatagcaattaatgccagaaaaggggatgtagaaatctagtgaaatggtgacagccctgatcttaggttcctgtaacaaaacaacacaaattaagtacaaagtaggagataacaggtacctccatgcagtatgtgcaagacctattgtcaacattaatagaaaaggtttctggaatgagggaaatgatcagtccattttagtcagattatagttgaagtgctatacttcagtatgagtaaacagaaatgtatccagaagaagagaggggtgttcaggacttctaagtataagtcagacattcatcaaatattgtggacgggggtcatggtttagagtagaaaattgggctaacagagaagctttgaattctcatagttaatactggaggaaatgagtcatcagtgataagcaaagctgcacacaatattgttggttcttactgactgaacttattttaagatttggttgccttttaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68675 - DNA, 3785 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtaagagaatgcaactgttgtagagggaaaactagatgtaatacgtgtgagttgaagccaggaaagattaaaaatgttttgctttgcaatttgacaccagtgctgttagggaactctgggttctaaaatgggataaaataggatattaataaaaaatggaatgactaggtataattaagggacgagtagacatgagtaattgggggatacaattttggagatgttgagtggtggtagatggttcagattaatgttgaaggattttcatattgcatttgccttactcagtttttaatcaagtactatgataagaaaatagatgtggtgattatattcatgggtgaaaaccagctaaagatagcaattaatgccagaaaaggggatgtagaaatctagtgaaatggtgacagccctgatcttaggttcctgtaacaaaacaacacaaattaagtacaaagtaggagataacaggtacctccatgcagtatgtgcaagacctattgtcaacattaatagaaaaggtttctggaatgagggaaatgatcagtccattttagtcagattatagttgaagtgctatacttcagtatgagtaaacagaaatgtatccagaagaagagaggggtgttcaggacttctaagtataagtcagacattcatcaaatattgtggacgggggtcatggtttagagtagaaaattgggctaacagagaagctttgaattctcatagttaatactggaggaaatgagtcatcagtgataagcaaagctgcacacaatattgttggttcttactgactgaacttattttaagatttggttgccttttaggtgagccaatggtggcagcagaagtaggcgtatgggataactattgtgtaaagaaacagcttcttcactcctggtaagtttgggaaaatgaaaactaaactgttagagaatcatacttttttcatttggtgttctctgtttagttgctcctttcccccatgaataatgtgatcagctggaagtatggaaactgaactagccctctgatgtgtagaggggaagggggaaatttaattggatgtaatgtgtgcagcttggttggaagtgggaagttgagtcgaattagggctcctaatcatctgagccatcttatttttgtccccctttcagcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68676 - DNA, 2510 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68677 - DNA, 2672 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtaagagaatgcaactgttgtagagggaaaactagatgtaatacgtgtgagttgaagccaggaaagattaaaaatgttttgctttgcaatttgacaccagtgctgttagggaactctgggttctaaaatgggataaaataggatattaataaaaaatggaatgactaggtataattaagggacgagtagacatgagtaattgggggatacaattttggagatgttgagtggtggtagatggttcagattaatgttgaaggattttcatattgcatttgccttactcagtttttaatcaagtactatgataagaaaatagatgtggtgattatattcatgggtgaaaaccagctaaagatagcaattaatgccagaaaaggggatgtagaaatctagtgaaatggtgacagccctgatcttaggttcctgtaacaaaacaacacaaattaagtacaaagtaggagataacaggtacctccatgcagtatgtgcaagacctattgtcaacattaatagaaaaggtttctggaatgagggaaatgatcagtccattttagtcagattatagttgaagtgctatacttcagtatgagtaaacagaaatgtatccagaagaagagaggggtgttcaggacttctaagtataagtcagacattcatcaaatattgtggacgggggtcatggtttagagtagaaaattgggctaacagagaagctttgaattctcatagttaatactggaggaaatgagtcatcagtgataagcaaagctgcacaacttgtcgagattcgaatctcgacaagtggtgcaccaagaggacggcttcagctacttctcttatccttactttctttaatagatatttattagagtgtccagtgaaaaggtgccacaatgcccagtatggtaaacaacaggtttgcattcatgaagcttccattcattctggagtctactaatttacctgaatggtgtaggcattctgtgacatgcctctccaggttgcatatgtcacacttttggtc

SEQ ID NO: 68678 - DNA, 2303 bp, Homo sapiens
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtaagagaatgcaactgttgtagagggaaaactagatgtaatacgtgtgagttgaagccaggaaagattaaaaatgttttgctttgcaatttgacaccagtgctgttagggaactctgggttctaaaatgggataaaataggatattaataaaaaatggaatgactaggtataattaagggacgagtagacatgagtaattgggggatacaattttggagatgttgagtggtggtagatggttcagattaatgttgaaggattttcatattgcatttgccttactcagtttttaatcaagtactatgataagaaaatagatgtggtgattatattcatgggtgaaaaccagctaaagatagcaattaatgccagaaaaggggatgtagaaatctagtgaaatggtgacagccctgatcttaggttcctgtaacaaaacaacacaaattaagtacaaagtaggagataacaggtacctccatgcagtatgtgcaagacctattgtcaacattaatagaaaaggtttctggaatgagggaaatgatcagtccattttagtcagattatagttgaagtgctatacttcagtatgtctcacacaaaaatttagacaaagtaaagctgataatccggaatgtgaagagaagactataggcgtt

SEQ ID NO: 68679 - DNA, 2483 bp, Homo sapiens
gaacggctagtgagcctccggtaaatcggacgagggaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68680 - DNA, 2052 bp, Homo sapiens
  misc_feature (26)..(26): n is a, c, g, or t
  misc_feature (30)..(31): n is a, c, g, or t
aacacgttaggctagtacgaggctgngtgnntcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68681 - DNA, 1839 bp, Homo sapiens
ttttcttggtaatttttgtagaaacaggttcataattgtgttgcccaggctggtcttaaactcccgggctcaggctgtccttcaccctcagcctcccaaagtgctgagattacaggcatgagccaccgtgcctggttcatgaagtctttagcagaaaaattaattgaaattcaggatcagatttttgtttatatacattttgaaggtttatgtgtagtaatgggaagccattgatggggaaaatcacatttcttttatgtgatttttcaaaaggagataatttgctttaatgtgatcaagtttgttccttattaatatgctacttgtcattctctgtaagtccctcttctctcttcactctgcacaaatcctgtttttgaaaatcatattttttctacacatagggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaaattttaatggtttaattttatgtggacgtatgttaaattatccaactaccctattgttaagcatttggttttaaaatttttatgctaatataaatgctcaagtaatttaaaatattgaaagcatccctgttggtataaatttctgagtaaatgcattggatcagttggactttgaacgcctttgaaatggctttgctaaaatgctcccgccacaaagttgtaggaaatgggaagaggagtcaactagaggcaagggagttgagagagctgcaactgtaaagggcaagaacaggcagaggtaaaaagatgatggaaggtgtggtgactaagggccacggttattgggtgaaatttgagattgtaggccaactgtattttcaagcttctgaacttaggcaaaatattcatcgcaaagtctctagcgtcatatttttctcacccaaattacgtttccacgagattatttatatatagttggtctatctctgcagtccttgaaggtgaagttgtgtgttactaggctgtgttttgggatgtcagcagtggcctgaagtgagttgtgcaataaatgttaagttgaaacctc

SEQ ID NO: 68682 - DNA, 1020 bp, Homo sapiens
  misc_feature (930)..(930): n is a, c, g, or t
  misc_feature (937)..(937): n is a, c, g, or t
  misc_feature (945)..(945): n is a, c, g, or t
accgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagagggatcnggttttnaagatggnagagagaaactcggaatgaaaaatttgtgttggtcacattaatgagagtggggcacaagttgttcagggcctctg

SEQ ID NO: 68683 - DNA, 1145 bp, Homo sapiens
gaacggctagtgagcctccggtaaatcggacgagggaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataacaaaagaaagagaacaacaacaaatagaccaaaacaaaagaaaacaacaaaaacaaacaaaacacaacaaaacaaaaaagccaacaaccaagaaaaagacacaaaagaaatagaattcaacagaagaaaaaaagcccaacatggatgataataagtatcaaatagatggcaggatagagatatcaatagaaacagcagaaggtagatatgccaaaaacagactgacagcggaacgaaaaggtagcgaaactagaaactagatcgataagactggaactataaaggccgatgaggaggaactgccgagaagtgaagcccagataaaagaatctaaaaagaaaaccctgaaaaaaagactcggagacataaaaagaggaggcagattataaaaaaaaattagaaagaacaagaggactgaggaggaacgaagtctagaaggacaagtaagagagtcagaagatgtgtagggacgctacgaagagtcggcgagggcggggaccggaagaaaataggacgttcaacacaccggagtaagagacggggtaaaatctcgaggaactcgataccgctaccgacgtatgaagttaagacgctttagaggacgcttgagaacgaatgggaaaagaagcgagaaagacgctatacagtaaaaaaataagcttagattggtttaatttggggacctcatggaaggattcgggtaagggaaacgaatagatcacaaaagcgtcttttaggaaaatactggtagtcacggtgatagag

SEQ ID NO: 68684 - DNA, 390 bp, Homo sapiens
gtaaaatgatttttttaaatttctatttttgttagcagtgctgtttgttagtatttggttattgactagacctgtcccaccttttcacctatcaaggtgggtgtggtcatcagtttaattcaacatgcatcacttccttgaccttttacctttcccttattccaccccagaaaggtgattgataaatgctgaatggctttgtcagtctgttccttcagcttgctcaggcagggtctttctttctcctctgaggagtcttaaggagacgtgttctctattaagttcacttaatattgccgttgtgtggccccacgtcgactccctatggtgctctactctagaggcagtgtggttggaggaatggactctaaactggagatcaagaaacca

SEQ ID NO: 68685 - DNA, 430 bp, Homo sapiens
ggttgtagcagcggtggctgctcccagcagcaccttctctgttcgtgccaagcagacctacccatactgtgcactgcccaggtacgtctagaatccaacccctacctcacctgggggtacttggcccctaagccatcaggggcccctggaaacaggctcagggagtgtcctggaagaggcactccctcagccctgagtgtgggggtattcctggggctcctgacagtggtgtggaagcaggagactcccctgtttccaaccaggcataccacagcaccccagcctctcggcagtgtgccagatccaacactcaggatatgaacattttcccagctgcctccaacagaccgaaacttgtcactggggagctgaaagggtcacactcctgggcaaggcagccctatgtgtattcactcactggccccttcgc

SEQ ID NO: 68686 - DNA, 1163 bp, Homo sapiens
acccaggagaagattgtggctggctatgctagtcgcttcatcgtgatcgctgatttcaggaaagattcgaagaatctcggggatcagtggcacaagggaatccccatcgaggtcatcccaatggcctatgtcccagtgagccgagctgtgagccagaagtttgggggcgtggttgaacttcgaatggctgtcaacaaggctggtcctgtggtgacagataatgggaattttatcttggactggaagtttgaccgggtacacaaatggagtgaagtgaatacagctatcaaaatgatcccaggctgtggtggacacaggcctattcatcaacatggctgagagagtctactttgggatgcaggatggctcagtgaacatgagggagaagcctttctgttgaccctgcaaggagcagagtgtgttcaccttgagtctccagcccacagccaaggtggacgtacctctccaggagcctttgccttaatgtatctctgcctggacaacttgtggtgggggggtggggggaagagtgggagggggagttaaatccagtcttatgaagtattgttattaaatgtctttttaaaaagagaaatataaacatatatttttactattaaaatattcagttttttaaatgaagtagaacttgagttcatgttttatatgaaatatttaccaaaaaaaaaaatgaggtaaactgtatttaaaacctttgacttgagtctgctggtaaagcttgttacttgtctgctaccctctgatttgtttttagttagttttattgtgagcacacatagtacctagttacatcttaagatcaggtttataaaactgtggagtggagcggtatggtatggaatgacttggaatgtaagctgtcagggagaaaatgttgttacacttttgctaagatctgggggtttcttcatattcctgctgttggaagcagttgaccagaaatgcttgccagtactgccaaagcactgctgtgaaatgtgaagtactttgttttttttatttttaatgattttctttttgttattaatatttttctctgttcctttgttattacttgcatggtttggcgtcagaagtcctacctctttatattgtttgcaggtttaaataaaacagtgtggtgccaaaaaaaaaaggaattc

SEQ ID NO: 68687 - DNA, 491 bp, Homo sapiens
ggcatttaggttgttttcaggcttctgctattgaagacacaagtgtgtatacttgtttatattgctttgcagaaatatgcagaaacaactacatagcatttactttttaagtggaatacagggtcaaagttatgtttataaatttaattgagataagcacattgctctcaaaagaagtaaacccatttacgtttctaccaagctgatatattcacatcctacaagtatttattgcatgatatgtattaggtactatttcagatgctagggaaatgtcagctatcaaaacagtcaaaaatttcttcctcctagggacggtgttataatggggagacagacaatgagtaaatacttaaaaaatgtatactatcagatagtgataagtgctatggaaaagaataaagtaagggaaaactggtatagagagggctagttggggttgtaattttaaatcagcttggtggggaaaggtctcactgaatgccatttga

SEQ ID NO: 68688 - DNA, 282 bp, Homo sapiens
acataatcagcaaagttactatcattgtcagtccaattagtctatacctataatacataaggtatctgaaagattacttctcattcatttattcacaatgccaggaactgtgccagatactgggtatacaatagcaaacaagacagacaaggaatcaaaccgagcttacatcccctcttctaaagacagatatttacatcctaatagaaatttccctaccaaatgtatttatacataaaacccagttctgttttaatgttagcacatgagatctagctgatg

SEQ ID NO: 68689 - DNA, 328 bp, Homo sapiens
aatctcctctaatattttatggagtttgactctcttcatcaacaccaggcccatggaataggagaacaatgtcaaggacagcagtgacactggtggcggcattttgccccaagctctgttctgagcactgtgcacctgtgaccccacttcattctcctatggcctgcccaatgctggacagccagctggctgattcaggactgtgccctgcagtctgggcagaagccttcacccactacttttgaggtgacacataacgcaggacaataccacacactggtccattggatcagtaaatgaacatattgagtccaagctccttttgtag

SEQ ID NO: 68690 - DNA, 310 bp, Homo sapiens
gtcctgtgggtgcctgctcatgtcccatgcgtggattgccagctggcaatccacgcatggaccagggcttcgccagcgggccagcaacaaagtgcaaggtgagagcatccaggaaggggcacttcctctgggctacacatggagggacttggctgtctgactgtagtatctctattcctctgttttctgaatgtttggtggtggtgggtgttgtttcctgctgccccaccccactgcccctgtaaggacaggttctcgctatattgcccaggccagtcttgaacacctgacttcaagcaatcctcttgcc

SEQ ID NO: 68691 - DNA, 1843 bp, Homo sapiens
cggggacttagtctcctccctgggtttggacactggcatcctgctttatgtgtgacaccactgcacccctctgagcctcggtttccccatctgtaaaatagaagcgatctaccctcacagggtcatatgactgctcctctccaccccacactggcccggggcgggctgggcgcgggcccctgcgggtgttgcaacgcccggccagaaagtgggcatcagctgttccgcctggcccacgtgacccgccgagcataaatgtgaccggccgcggctccggcagtcaacgcctgcctcctctcgagcgtcctcagcgcagccgccgcccgcggagccagcacgaacgagcccagcaccggccggatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctgatagtagcttgaa

SEQ ID NO: 68692 - DNA, 2162 bp, Homo sapiens
cggggacttagtctcctccctgggtttggacactggcatcctgctttatgtgtgacaccactgcacccctctgagcctcggtttccccatctgtaaaatagaagcgatctaccctcacagggtcatatgactgctcctctccaccccacactggcccggggcgggctgggcgcgggcccctgcgggtgttgcaacgcccggccagaaagtgggcatcagctgttccgcctggcccacgtgacccgccgagcataaatgtgaccggccgcggctccggcagtcaacgcctgcctcctctcgagcgtcctcagcgcagccgccgcccgcggagccagcacgaacgagcccagcaccggccggatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctgatagtagcttgaaaaaaaaaaaaaaaaaaaaaaaaaaaaaaaaaaaaaaaaaaaaaaaaaaacaaaaaaaaaaaaaaaaaaaaaaaaaaaaaaaaacaagggggggcggcgcgcagaagcccccccggacgtacgaacaagaatactaacaacccccccctacttcacagcaaggaacaggccacaaaagaggatggtgtattatctacacacgccgcagacacaggaggcggcggggcagaccaccacgctctgtgcgcgcgcaaagatagactagcaacgaagagaatagtagggacgaagagacagaggtgtctccatgacacgcgcgg

SEQ ID NO: 68693 - DNA, 1403 bp, Homo sapiens
aagcaattctctgcctcagcctcccgagtagctgggattactggcactcgcaaccatacccggctaattttttgtatttttagtagagacggggtttcaccatattggccaggctggtcttgaactcctgacctcgtgatccacctgccttggcctcccaaagtgctgggattacaggcgtgagccactgcgcccggccctatcacattttaataaccagggatgggactgaacttgaattttgacctcagagctcctgctttctagctcctgccccatcatcaccatgcttagcaaacgtgtgagtttgagaggaagatttacagctcagacctaattgctggcaaagtttaaggagaggacagggagcaggcagaagtctgaaaaccacgcctgggcccaagaatgttttcacaatgtggcctggctgcacagggaagaacagacagcttgaagaagtagtgagctgcccgtctttgaaggtattcaagcagtggctagagggacacctgtctgtggtcttgcagaatcctggcgttgggcagtgactgtaccacagaccctgaggccgctctgctttgctttcctatgacatcagacaccctgatgcacgcccacctgttaatgaccttgccccattttctctttcagattctattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctgatagtagcttgaa

SEQ ID NO: 68694 - DNA, 1024 bp, Homo sapiens
  misc_feature (965)..(965): n is a, c, g, or t
  misc_feature (975)..(975): n is a, c, g, or t
  misc_feature (991)..(991): n is a, c, g, or t
  misc_feature (1018)..(1018): n is a, c, g, or t
cggggacttagtctcctccctgggtttggacactggcatcctgctttatgtgtgacaccactgcacccctctgagcctcggtttccccatctgtaaaatagaagcgatctaccctcacagggtcatatgactgctcctctccaccccacactggcccggggcgggctgggcgcgggcccctgcgggtgttgcaacgcccggccagaaagtgggcatcagctgttccgcctggcccacgtgacccgccgagcataaatgtgaccggccgcggctccggcagtcaacgcctgcctcctctcgagcgtcctcagcgcagccgccgcccgcggagccagcacgaacgagcccagcaccggccggatggagcgtccgcaacccgacagcatgccccaggatttgtcagaggccctgaaggaggccaccaaggaggtgcacacccaggcagagaatgctgagttcatgaggaactttcagaagggccaggtgacccgagacggcttcaagctggtgatggcctccctgtaccacatctatgtggccctggaggaggagattgagcgcaacaaggagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactcccctgggaaaaatgaactccccgccaattccagggccaaaanggttgattanaaaaaaaggccccaanaaattgcgtttccctggcttccaacantcccaa

SEQ ID NO: 68695 - DNA, 779 bp, Homo sapiens
  misc_feature (20)..(20): n is a, c, g, or t
  misc_feature (28)..(29): n is a, c, g, or t
cgcgtgacgcgtgggtcganccacgcgnncggattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctgatagtagcttgaa

SEQ ID NO: 68696 - DNA, 1362 bp, Homo sapiens
tatactaaaattggaacgatacagagaagattagcatggcccctgcgcaaggatgacacgcaaattcgtgaagcgttccatatttttagagcccagtcttcgcccctgtctacttcccagaagagctgcaccgcaaggctgccctggagcaggacctggccttctggtacgggccccgctggcaggaggtcatcccctacacaccagccatgcagcgctatgtgaagcggctccacgaggtggggcgcacagagcccgagctgctggtggcccacgcctacacccgctacctgggtgacctgtctgggggccaggtgctcaaaaagattgcccagaaagccctggacctgcccagctctggcgagggcctggccttcttcaccttccccaacattgccagtgccaccaagttcaagcagctctaccgctcccgcatgaactccctggagatgactcccgcagtcaggcagagggtgatagaagaggccaagactgcgttcctgctcaacatccagctctttgaggagttgcaggagctgctgacccatgacaccaaggaccagagcccctcacgggcaccagggcttcgccagcgggccagcaacaaagtgcaagattctgcccccgtggagactcccagagggaagcccccactcaacacccgctcccaggctccgcttctccgatgggtccttacactcagctttctggtggcgacagttgctgtagggctttatgccatgtgaatgcaggcatgctggctcccagggccatgaactttgtccggtggaaggccttctttctagagagggaattctcttggctggcttccttaccgtgggcactgaaggctttcagggcctccagccctctcactgtgtccctctctctggaaaggaggaaggagcctatggcatcttccccaacgaaaagcacatccaggcaatggcctaaacttcagagggggcgaagggatcagccctgcccttcagcatcctcagttcctgcagcagagcctggaagacaccctaatgtggcagctgtctcaaacctccaaaagccctgagtttcaagtatccttgttgacacggccatgaccactttccccgtgggccatggcaatttttacacaaacctgaaaagatgttgtgtcttgtgtttttgtcttatttttgttggagccactctgttcctggctcagcctcaaatgcagtatttttgttgtgttctgttgtttttatagcagggttggggtggtttttgagccatgcgtgggtggggagggaggtgtttaacggcactgtggccttggtctaacttttgtgtgaaataataaacaacattgtctgatagtagcttgaa

SEQ ID NO: 68697 - DNA, 690 bp, Homo sapiens
ggctgatcggccggtcctatgtctggggctagatttcaaaacccacgtaatgaaaaagtcagtttacaagcctaattttgttgttttttttttatatcaattaacggcaggaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacat

SEQ ID NO: 68698 - DNA, 499 bp, Homo sapiens
  misc_feature (24)..(24): n is a, c, g, or t
aggctgtctagaggatcccgtcanttaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacat

SEQ ID NO: 68699 - DNA, 1262 bp, Homo sapiens
  misc_feature (24)..(24): n is a, c, g, or t
aggctgtctagaggatcccgtcanttaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataagtttcaagactgctctgtccctcacatgtacacatacatgcctgagacagataatgtggttcagtatttatctttacagttttacagcaaatataatgcagggtggatggagacggggtaggtctgcagcatcataatgctattcataaactgggtgtgagctgggtgctggcttctcagaggataaacacttttgggagtgtcatttttacttaatgttggatggacaccttttcaaacaaaaactaccatggatctattacagagtagatttgcacaaatgtttaagataaaacgtgaatcttcagagaaatatctgtttatggcagactgttctggaccatagaatcacttggtttacaaattccctattttctcataagggatcattttcaaaatcttctaccaataaatggtgattgaaaggacagcacaaagtaaataatttcttatgtggataaatactaattcctccttgttagaatgatattttaaaagtaacatcttttttttaattttttttgagacaagatcctttgtcccccaggctggagtgtggtgccatgatctcggctcactgcaacctcagcctcccaagtaggtgggactaaagacatgtgccaccatgcctggctgatgtttgtattttctatagagatggtttcatcatgttgcccaggctggtatcaaactcctggataaaagagacccacctgcctcagtctcccaaagtgctgggattacaggtgtgagccaccacg

SEQ ID NO: 68700 - DNA, 3634 bp, Homo sapiens
agaccaaggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacataagtttcaagactgctctgtccctcacatgtacacatacatgcctgagacagataatgtggttcagtatttatctttacagttttacagcaaatataatgcagggtggatggagacggggtaggtctgcagcatcataatgctattcataaactgggtgtgagctgggtgctggcttctcagaggataaacacttttgggagtgtcatttttacttaatgttggatggacaccttttcaaacaaaaactaccatggatctattacagagtagatttgcacaaatgtttaagataaaacgtgaatcttcagagaaatatctgtttatggcagactgttctggaccatagaatcacttggtttacaaattccctattttctcataagggatcattttcaaaatcttctaccaataaatggtgattgaaaggacagcacaaagtaaataatttcttatgtggataaatactaattcctccttgttagaatgatattttaaaagtaacatcttttttttaattttttttgagacaagatcctttgtcccccaggctggagtgtggtgccatgatctcggctcactgcaacctcagcctcccaagtaggtgggactaaagacatgtgccaccatgcctggctgatgtttgtattttctatagagatggtttcatcatgttgcccaggctggtatcaaactcctggataaaagagacccacctgcctcagtctcccaaagtgctgggattacaggtgtgagccaccacg

SEQ ID NO: 68701 - DNA, 2793 bp, Homo sapiens
agaccaaggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgttagagatacgggatcctctagatcacctc

SEQ ID NO: 68702 - DNA, 675 bp, Homo sapiens
atctgacaggtaccgtatctctaacattaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacat

SEQ ID NO: 68703 - DNA, 1676 bp, Homo sapiens
agaccaaggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactggtattcggcagctttgaatttctactgaagattttcacatgctacaattcatcctgggttcttccctcctttaacaacattttcattaaaaacaaattatgtgatcag

SEQ ID NO: 68704 - DNA, 1553 bp, Homo sapiens
agaccaaggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagggcaacttgcaggttttattcatctctgcaatcacagagactgacacagagggtatctgctgaatgaatgttgaagagattttgacacgaaattctaattgggacattgcaagtggctatgatgataaactgcagttaagatacagagggtggtgcagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaaccaagttcaaatgccggatacttgaatgacaaaggtgaatactccaactaccaagtctatagatgtgggcccttcgataagatctctgccggggcctcatgttagacacacgggcaacaattacacggccctaaaactacgccacaaaaatcctcaagtacgggaaggcaagcgcagaaatgaagaaactcgaagaataaggatataatcccagaaccaaacgtgacagcaggggcaaactccacaaggagcaaacggaatctagacaagcgggacacgaaacaccgcagaaccagcggaagtaatgataagagacaataaggcagaaagcgcaaagaaaggcagaaccaacaagaagaacacagaacacacaagaaag

SEQ ID NO: 68705 - DNA, 689 bp, Homo sapiens
cagaaacactgacatggtttctttgattcaggagtggcactgattgaaatatgggacatcatgaccatattctgagctcaagaacactgaaatttatgtatatatacacacacgtatacgtgacgtacataaacattcttttgcttttcttttacccaggaccaagaactatatttctttcatgaactcagccctggaagttgcttttttctgccaaaaggagcctacatttataatgcacttattgaattcattagggtaagtcatatttattgctttcttctttagatttaggatatgtgatcattttattaaataaggtctactaaaaggaaagataatctgtatttgagaagaaatatataagacgataagtaaaagtagaagtctgtggcctcataaatcatccctaatagttgattttgcccatatacacatagaaactggtgagcttgaagggggacctgtggtccttgacataggagctctgtgccctctttgactttgatcatttatttgtattttctttgaaaaaacggtttttacattgcttttttcctttgtaaattatgaaatgtttcaagtataagtttatagagaatagtatatccaatatcttgtacttaactacccacatttaacaaatattcacattgggctatatttgcttgagattttttcattcatga

SEQ ID NO: 68706 - DNA, 2871 bp, Homo sapiens
agaccaaggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacat

SEQ ID NO: 68707 - DNA, 3029 bp, Homo sapiens
agaccaaggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagggcaacttgcaggttttattcatctctgcaatcacagagactgacacagagggtatctgctgaatgaatgttgaagagattttgacacgaaattctaattgggacattgcaagtggctatgatgataaactgcagttaagatacagagggtggtgcagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacat

SEQ ID NO: 68708 - DNA, 2675 bp, Homo sapiens
agaccaaggtcagcggagagtaggcatgtagcttctgcagttgctcctcctcaccctccgcgacctgatttcctagaagggctctgtcacccgaaaagattttccactggcttagaggagggagggcccgccttcccccgttatccattggctgctcgttccgccgcaagttgggggcggggttagggcgcctttcgattgcatcagctggtccagccgaggccaagtcccgggcgctagcccacctcccacccgcctcttggctcctctcctctaggccgtcgctttcgggttctctcatcgcttcgtcgttcgccaatgtttgaggagaaggccagcagtccttcagggaagatgggaggcgaggagaagccgattggtgctggtgaagagaagcaaaaggaaggaggcaaaaagaagaacaaagaaggatctggagatggaggtcgagctgagttgaatccttggcctgaatatatttacacacgtcttgagatgtataatatactaaaagcagaacatgattccattctggcagaaaaggcagaaaaagatagcaagccaattaaagtcactttgcctgatggtaaacaggttgatgcggaatcttggaaaactacaccatatcaaattgcctgtggaattagtcaaggcctggccgacaacaccgttattgctaaagtaaataatgttgtgtgggacctggaccgccctctggaagaagattgtaccttggagcttctcaagtttgaggatgaggaagctcaggcagtgtattggcactctagtgctcacataatgggtgaagccatggaaagagtctatggtggatgtttatgctacggtccgccaatagaaaatggattctattatgacatgtacctcgaagaagggggtgtgtctagcaatgatttctcttctctggaggctttgtgtaagaaaatcattaaagaaaaacaagcttttgaaagactggaagttaagaaagaaactttactggcaatgtttaagtacaacaagttcaaatgccggatattgaatgaaaaggtgaatactccaactaccacagtctatagatgtggccctttgatagatctctgccggggtcctcatgttagacacacgggcaaaattaaggctttaaaaatacacaaaaattcctccacgtactgggaaggcaaagcagatatggagactctccagagaatttatggcatttcattcccagatcctaaaatgttgaaagagtgggagaagttccaagaggaagctaaaaaccgagatcataggaaaattggcagggaccaagaactatatttctttcatgaactcagccctggaagttgcttttttctgccaaaaggagcctacatttataatgcacttattgaattcattaggagcgaatataggaaaagaggattccaggaggtagtcaccccaaacatcttcaacagccgactctggatgacctcgggccactggcagcactacagcgagaacatgttctcctttgaggtggagaaggagctgtttgccctgaaacccatgaactgcccaggacactgccttatgtttgatcatcggccaaggtcctggcgagaactgcctctgcggctagctgattttggggtacttcataggaacgagctgtctggagcactcacaggactcacccgggtacgaagattccaacaggatgatgctcacatattctgtgccatggagcagattgaagatgaaataaaaggttgtttggattttctacgtacggtatatagcgtatttggattttcttttaaactaaacctttctactcgcccggaaaaattccttggagatatcgaagtatgggatcaagctgagaaacaacttgaaaacagtctgaatgaatttggtgaaaagtgggagttaaactctggagatggagctttctatggcccaaagattgacatacagattaaagatgcgattgggcggtaccaccagtgtgcaaccatccagctggatttccagttgcccatcagatttaatcttacttatgtaagccatgatggtgatgataagaaaaggccagtgattgttcatcgagccatcttgggatcagtggaaagaatgattgctatcctcacagaaaactatgggggcaaatggcccttttggctgtcccctcgccaggtaatggtagttccagtgggaccaacctgtgatgaatatgcccaaaaggtacgacaacaattccacgatgccaaattcatggcagacattgatctggatccaggctgtacattgaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacat

SEQ ID NO: 68709 - DNA, 699 bp, Homo sapiens
ctcccccttaactcttcccatatcctctctttccccccccccctcatttctattcccttctctaccgcttccccgttgcccattctggcccacattgatctggatccaggctgtacattgaataaaaagattcgaaatgcacagttagcacagtataacttcattttagttgttggtgaaaaagagaaaatcagtggcactgttaatatccgcacaagagacaataaggtccacggggaacgcaccatttctgaaactatcgagcggctacagcagctcaaagagttccgcagcaaacaggcagaagaagaattttaatgaaaaaattacccagattggctccatggaaaaggaggaacagcgtttccgtaaaattgactttgtactctgaaaacgtcaatttatattgaacttggaggagtttggcaaagtctgaataggtcaacctgcaggcgtaactatttttgacctagtcagtttttaaacaatgtgcatttgaaggagttaattaaaagagagccaataaaatgattttactcattcagtatctgagtactggaagtgaaacatgaggaatgctttagtgtaatgtgggagaacttttttgtaaatttaatgcaattgaaaaagttttcaaattcaattaagataactagaattggattatggtgtaaaaataaaaaaaaaatttattcacat

SEQ ID NO: 68710 - DNA, 446 bp, Homo sapiens
ctttcaattatctttgttatttactgagatgtagaattgctggatcatatggtataatttttttaggaatcaccataccgttttctacagcagctaaactactttacattctcatcagcaatgtgcaagggttccaatttctccatttcctcaccagcacattttctatgtttttaaaaatagtagccatacaactgggtatgaaattaaaaagataaattttacgttatgtgtattttaccacaataaaaatgtccaaaggaactgaaagtaccaatatttggtgcagttctgtcagtagaagtaaatatggattcgctatattccttaaaaatatattttcactctaagtttgtagcacctacaattttattaagacctcatagttctgaagtttaaaaagtcataaattgtttcagaaataaaacgaaatcatgaatccaaaa

SEQ ID NO: 68711 - DNA, 1756 bp, Homo sapiens
  misc_feature (35)..(35): n is a, c, g, or t
ctgactaacgtgggcggagctctagctcgcgtatnctgaggaggcggggttggcctaggcgaagatccggactctgggtgttttgctaccgtgaccgtttagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttg

SEQ ID NO: 68712 - DNA, 1604 bp, Homo sapiens
  misc_feature (35)..(35): n is a, c, g, or t
ctgactaacgtgggcggagctctagctcgcgtatnctgaggaggcggggttggcctaggcgaagatccggactctgggtgttttgctaccgtgaccgtttagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttg

SEQ ID NO: 68713 - DNA, 694 bp, Homo sapiens
  misc_feature (35)..(35): n is a, c, g, or t
ctgactaacgtgggcggagctctagctcgcgtatnctgaggaggcggggttggcctaggcgaagatccggactctgggtgttttgctaccgtgaccgtttaggtgagtggaatagccaagaacatttcggcaaataacaaaaacaaaacgtgcggtcacttgtgagtggatgagaactgtgaggaaacagcctctcagcccggttcgtttccggtggtctcgcgtttgctgagctgtcgcctggctttctaaatctggtcccgggtgtgtggcgagggtgacgggtgggatgtgtgcctgagtgttttgtaatcctttgtctatttctgccttcagaaacccttgtgtgttaaaatattggagaaggctcattctttgaccatgactcgaagtgtgtaacctttgtgctggacgccagtgttattccatagcacgcccaggtctcctccccacttttgcacctgtttcgtaagctcaccctttctgcctcccaggagttggctaacatgtcacaagtgagacctgtggaggatttgtttttcctaagtttcctcctacatcccccctgccccacaccattagttccttgaccggttcctgagttaagattaaacagtgtaaactagtttagttttggtggggtttttttctcccaaagtaatttttttttttttgagaccgagtttcgctcttg

SEQ ID NO: 68714 - DNA, 702 bp, Homo sapiens
agcgatgtttaaaataatttaagtatgattatataagatttgggggccgggtgcagtggctcacgcctcccaaagtaattttaaaaaggaatgaactggtttgatttttccgctttcaaaattctgttttcatatgataaaccacaaaaatcagtaaagctgtctagtcttattttatagttcacattttaggattgaacgggccttaaaagtaatctggtctctttacctgctttgctccatagtttggacaattccggggataaaaagtccgatcctttaggcagcccactgcatttgatccacagggtctgggcaatgacgaagctccaggactggtatggcatgtccctcactgccgtattcagcagcaagcctagctgtgtaatttgtgaggctcaatgcaaaatgaaaatgcagcgtcccttgttcaaaaagaaggggaaaagtgctattaaagggaaggaacatttaactcctaatgcagaatcattgaaatttcacatttcattttgtattttttcttttttctttttttttttagaaacagagtctcgctctgtcgcccaggctggagtgcagtgtggcccgatctcagctcactgcaacccccacctcccgggctcaagagatccacccacctcagcttcccaagtaggggcgcctgtaaccccagctactcgggaggctgaggcaggagaa

SEQ ID NO: 68715 - DNA, 2139 bp, Homo sapiens
ctgttcttaaggcaggttagtttaattttatagaagaaatatttttcaaacagtacaaatgacacaattagagagaaaagagtgacaaaaaacaaagagatgaatactgattataacttattcccacaacagaaggctacttatttctacaattatcaatcaaagcctgacaattcagtgattagatgaagtgaaagccaaattcccttttacatgtggtactatttcaaaagaaccctggtggcaggatcctgatggttttgagaccagaactgcttctaaaacctggcagcgtttttttgttttgtttttatcgcgaggcctggtagatggacagattgaaacatagatggaaacacctaggacttcacttttctggcatgtggggtattttctggggttggcgtggcagtctgaactagtcagaagctccaagaccacgtcatgaatgacaagcaacatagggcgcttggtgtccttctgcctgctcaggccacctccactgcctgcatctgcacctgcagagaactgcgcggctctctggccttcctttgtcttttctttccttgtcatggctgcattgagctgcaaaagcggacacaggcagggaggcagggggaggttcaaaggtaaaggtggcaaacacgagggctccttggactgatacggaagcaggcactgcatctgtttcttgcaggctatcagtgagattctatttttaaaaaacccagccaggcatggtggctcgcaagtccaagatcagcctgggcaacagagcaagaccttgactctaagaaaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttggaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatgatatgtttgtaatatcttacct

SEQ ID NO: 68716 - DNA, 2855 bp, Homo sapiens
  misc_feature (35)..(35): n is a, c, g, or t
ctgactaacgtgggcggagctctagctcgcgtatnctgaggaggcggggttggcctaggcgaagatccggactctgggtgttttgctaccgtgaccgtttagaaacagagtctcgctctgtcgcccaggctggagtgcagtgtggcccgatctcagctcactgcaacccccacctcccgggctcaagagatccacccacctcagcttcccaagtagctgggactacacgcgcccgccaccacaaccggctaatttttgtacttttagtagagaccaggtttcaccatgttggccaggcaggtctcgaactcttgacctcaagtgatccgtctgcctcggcctcccaaagtgctgggagtacaggcgtgaatcaccgcgcccggccacatttgaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttggaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatgatatgtttgtaatatcttacct

SEQ ID NO: 68717 - DNA, 2511 bp, Homo sapiens
  misc_feature (35)..(35): n is a, c, g, or t
ctgactaacgtgggcggagctctagctcgcgtatnctgaggaggcggggttggcctaggcgaagatccggactctgggtgttttgctaccgtgaccgtttagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacatattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttggaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatgatatgtttgtaatatcttacct

SEQ ID NO: 68718 - DNA, 2415 bp, Homo sapiens
  misc_feature (35)..(35): n is a, c, g, or t
ctgactaacgtgggcggagctctagctcgcgtatnctgaggaggcggggttggcctaggcgaagatccggactctgggtgttttgctaccgtgaccgtttagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaagcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttggaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatgatatgtttgtaatatcttacct

SEQ ID NO: 68719 - DNA, 2565 bp, Homo sapiens
  misc_feature (35)..(35): n is a, c, g, or t
ctgactaacgtgggcggagctctagctcgcgtatnctgaggaggcggggttggcctaggcgaagatccggactctgggtgttttgctaccgtgaccgtttagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttggaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatgatatgtttgtaatatcttacct

SEQ ID NO: 68720 - DNA, 2413 bp, Homo sapiens
  misc_feature (35)..(35): n is a, c, g, or t
ctgactaacgtgggcggagctctagctcgcgtatnctgaggaggcggggttggcctaggcgaagatccggactctgggtgttttgctaccgtgaccgtttagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcattcaattgggcgagattaaatcagctgatacttatttagaaaaagaaataattaaggttaattaattgattgacttattaattaatactgatataaaaccaatagaaatgatcccacaggccaggcacaatggctcatgcctataatcccagcactttgggaggctgaggcaggaagcacactggagcccaggagtttgagaccagcttgggcaacatagcaagaccctgtctatttttttaaaaaagtaaaaaatagaaattatctcactacttaaatcccatttttttcacttcatatgaaagaacatattgatagtatattctatattatttcatagatctgtctgaaagagattgggaacaaaaatatctaattgagatattctttaattttttacatagcagctttattttttttattctgtagtatcagcgaaatcagtcatgtttataccttgaatataaatatcaggaatcatgcaattatttctactatgtatttagtagtatcttatatttgtataacattattacattttgcaaattagtatcacaactgctaagtagatgtttctgagtattagaaaaatcagtgttattacctgcaggatattaaaaaacatttggaaaaagagaaaaagaaaaatcagtgtttagaaatgttgatagttattgaatctttgaattgaattttaaaaatccattctagtaatcagagtatactttttttatagaacaaggtggcaggtggggagccctttacccttctggtgaagttaaaccatagaagtttacaatttgcctttcacaaacattagcagtccgggcatggtggctgaagcctgtgatcccagcatgttgggaggccgagtgggaggattgcctgagcctaggagtttaaaccagcctgggcaccatggtgagaccccatctctattatttaaaatgtttcttaaataaaaaaaacacaaacattagcaactagttggctagccataattcctcccttgtttcgattgccagttagaagcaatttttatttcactggttatttgcaagagaaggggtaaaaaaacagcatcagagtgcaacactgaagtgagcttactttaatttgtaagtgaagctgttgctgaacatgaccactatcgttgctgaaatataaaattatactcactgattgtaatggttgaaattttcctgaataatcattagccaaagatcaactctctaatggtgctaatggcaatctagctaatgtgcaaatttaggaagtcttcagtactaagtacataattttcaaataatattttttaattgtctactttggatgttagctatgtcttgtgagtataaattccaattttaagcactattttgatgcaaaaaaatgaataaaaaatttaatttatgatatgtttgtaatatcttacct

SEQ ID NO: 68721 - DNA, 1478 bp, Homo sapiens
  misc_feature (35)..(35): n is a, c, g, or t
ctgactaacgtgggcggagctctagctcgcgtatnctgaggaggcggggttggcctaggcgaagatccggactctgggtgttttgctaccgtgaccgtttagaaacagagtctcgctctgtcgcccaggctggagtgcagtgtggcccgatctcagctcactgcaacccccacctcccgggctcaagagatccacccacctcagcttcccaagtagctgggactacacgcgcccgccaccacaaccggctaatttttgtacttttagtagagaccaggtttcaccatgttggccaggcaggtctcgaactcttgacctcaagtgatccgtctgcctcggcctcccaaagtgctgggagtacaggcgtgaatcaccgcgcccggccacatttgaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaaagagacgcccccccttcgactctggaggttcgacagggctatatagggagatgtttctgaaaaaaaaaa

SEQ ID NO: 68722 - DNA, 477 bp, Homo sapiens
tagttccagtgtcagttcttggggattctcattttttgcttgctcattttttacccaaattcgtcttcctcttgagccaagaagactgtgtgcggcagtagaaatagcacaggccttggggacacgcagggctgggtgtgaaccctgatactgcctcatgctcataacctgccccgaggcaggtttttcactgctctatgagacaatttctacctctggaaaaggaggctggtgattgtccctatctcaaagggttgtagggaagagagttgactttgaaaactccacaaacaaggcttacctgaattattggcatataggcagcctgcaggacgtgttagccactttcttcttctcccctgactcttctcagtcgctggttatcagtgtcttttctaagcacagctctggaggaactggtccttatcaggcaagttggggtcccactatctttggaaggaacgaccatccagaatc

SEQ ID NO: 68723 - DNA, 1688 bp, Homo sapiens
tgagaactcaggccgagggcttcagacgctggtgcgcctgcttggggctcctgtgctcagctcagcctgagcttccacactcagcgctcagcaatggcccgggggcggggcgcggtcctcgcagattctcaaaggtagccgggatcctcgtccagcagtgtcagctcaggctcagcctccccagagacaacaccgggagcctcatctctctcctcaccctgctgtgactccaccacaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcggctcctcaggtctttagcctccaccttgtctaagctttggtctataaagtgcgctacagaaatggcattca

SEQ ID NO: 68724 - DNA, 1916 bp, Homo sapiens
ttaaggtatggcccaaatgaccctgtgaggacacaggacagaggtccagtgtctccagagcccattccttctgtgcctctgctgcctgcaactgataaacctcttatctggcccaggcaggggagcccagggccaggataggaggagagggcagagctgctatcaaccaccaggcctgggccatatcttggagaggaggaggggctgtctgcttgcctctttccacaacttgttcttggggatcctcaagcatatactgtcatcatcttggaaagaaaaggctgagaacgtaaaactgaggacagaggaggaaagcagggtgacccctgatgttgccctagaaaatggaaaacaaaacacagcaaaacagaaaaacagaagatctgactctgcctttagccaggaaaacagtttgggggagtaaaaagtattagggaaaagagtgggcattttgcctggaaaaaaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcggctcctcaggtctttagcctccaccttgtctaagctttggtctataaagtgcgctacagaaatggcattca

SEQ ID NO: 68725 - DNA, 1592 bp, Homo sapiens
atgaatccagcatgagtgaggatggggaggaggcggtctctccttccctcaggggaagctggagggagcccctccaaggaggtagtgcaaacttgctgaccctagcaggtgtagctctaacacctcttttcctttgacacaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccaccttatgagctcccagcatccacatcccatgtcccagatcccccatactcctatggcaacatggccataccagtctccaagccactgagcctctcaggcctgctcagtgagccgctccaagaccccttagccctcctggacattgggctgccagcagggccacctaagccccaagaagacccagaatccgactcaggattatccctcaactatagcgatgctgaatctcttgagctggaggggacagaggctggtcggcggcgcagcgaatatgtagagatgtacccagtggagtacccctactcactcatgcccaactccttggcccactccaactataccttgccagctgctgagacccccttggccttagagccctcctcaggccctgtgcgggctaagcccactgcacggggggaggcagggagtcgggatgaacgtcgggccttggccatgaagattccttttcctacggacaagattgtcaacttgccggtagatgactttaatgagctattggcaaggtacccgctgacagagagccagctagcgctagtccgggacatccgacgacggggcaaaaacaaggtggcagcccagaactgccgcaagaggaagctggaaaccattgtgcagctggagcgggagctggagcggctgaccaatgaacgggagcggcttctcagggcccgcggggaggcagaccggaccctggaggtcatgcgccaacagctgacagagctgtaccgtgacattttccagcaccttcgggatgaatcaggcaacagctactctcctgaagagtacgcgctgcaacaggctgccgatgggaccatcttccttgtgccccgggggaccaagatggaggccacagactgagctggcccagaggggtggaactgctgatgggatttccttcattcccttctgataaaggtactccccaaccctgagtcccagaaggagctgagttctctagaccagaagaggatgacaatggcaacaagtgtttggaagttccaaggtgtgttcaaagaggcttgccttgagggagggctggaatctgtcttccctgactcggctcctcaggtctttagcctccaccttgtctaagctttggtctataaagtgcgctacagaaatggcattca

SEQ ID NO: 68726 - DNA, 906 bp, Homo sapiens
ttaaggtatggcccaaatgaccctgtgaggacacaggacagaggtccagtgtctccagagcccattccttctgtgcctctgctgcctgcaactgataaacctcttatctggcccaggcaggggagcccagggccaggataggaggagagggcagagctgctatcaaccaccaggcctgggccatatcttggagaggaggaggggctgtctgcttgcctctttccacaacttgttcttggggatcctcaagcatatactgtcatcatcttggaaagaaaaggctgagaacgtaaaactgaggacagaggaggaaagcagggtgacccctgatgttgccctagaaaatggaaaacaaaacacagcaaaacagaaaaacagaagatctgactctgcctttagccaggaaaacagtttgggggagtaaaaagtattagggaaaagagtgggcattttgcctggaaaaaaggtttctagagccatctgggctttccgggaacctggaccagactctggcccagtaggatgtccccgtgtcctccccagcagagcaggaacagggtgatacagctgtccacttcagagctaggagagatggaactgacttggcaggagatcatgtccatcaccgagctgcagggtctgaatgctccaagtgagccatcatttgagccccaagccccagctccataccttggacctccaccacccacaacttactgcccctgctcaatccacccagattctggcttcccacttcctccaccacctgccagctggctcagccggctgagcaagcgggctggcgttacatggggtaacgacgggtggggtcactttccgtaaatggtagtaagggtagggaagcgagtttgacctggtagggtgagaagacatatgcgagtgcta

SEQ ID NO: 68727 - DNA, 1770 bp, Homo sapiens
tgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaataaaaaaat

SEQ ID NO: 68728 - DNA, 1801 bp, Homo sapiens
tgaaccagttgtttccgtcttgtcggtctgtcagggttggaaagtccaagccataggacccagtttcctttcttagcttacgttatctaccagagcaccgtgggctgttacttgccttgagttggaagcggttcgcatttataccggaatataaatagtttctggaaaggacactgacaacttcaaagcaaaatgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgctgatgcggccgaaacccccttattaaattgcatttacgtctgaaagaaaaaacca

SEQ ID NO: 68729 - DNA, 1447 bp, Homo sapiens
cagaatttggtacttatgaagactgtttaatttgtaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaaagatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaaaatttaaaattaaatgcaaatccgcaaagcaataaaaaaat

SEQ ID NO: 68730 - DNA, 589 bp, Homo sapiens
tggtcttcactggacaccatgaaccacactgtccaaacttcttctctcctgtcaacagcgccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcttactccgtgaagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtaaaaaataa

SEQ ID NO: 68731 - DNA, 278 bp, Homo sapiens
caaaaattagccgggtgtgctggtacatgcctgtagtcccagctactccggaggctgaggcgggagaatcacctgaacctgggaagtggaggttgcagtgagccgaggtcgcgccactgtactccagcctgggcaacagagtgagactccgtctcagaaaaaacaaaaaatttatttaatacacacaaaaataaaaatatccacgttttggggacagttttctaagtggaaggtcttaatctcttggagaagtggggcatgaatcctgccagcccttc

SEQ ID NO: 68732 - DNA, 346 bp, Homo sapiens
ctagtattttctagagtgctgtgatatttgcagaattaacccacaaaacagtatcctatgggccaaccggtgatgagactgagtttgcctttgagaactccggtgggtgttctaacctaactttcctacctctcttcactgtcatttatattgttgcctgaggactcttcctaatacctagccaaagtatggggggcctctgctgtctgagaggtcaacttctaacaatttagtgtgacctcaaggccaccccatgacctgactccattctcctttttcactctcgtcttcggccacctctctcaatttgccagactatctgctctccctggaatccaccatggac

SEQ ID NO: 68733 - DNA, 188 bp, Homo sapiens
tacggtgtaacatcctcctcctccttctcctcctcctcctcgggagccgctgcaacttcccctcagccagcctcctcctctgcctggggactgcaaaggcatgggatagacccagagccgcttccctctgtctcccctccagccctcgctcaattttcccccctttaaattaaagtctgttcctcgct

SEQ ID NO: 68734 - DNA, 319 bp, Homo sapiens
ttgtgaagaataaatttggtaatacaatttaaaatatctggaaaattataaatggggacaacagatcaatggaggaggattgagcttagatttaattgttaagattgttaggttttctggttgttcacttagtttttagaaaatttttaaaaagactaaaaaaaaacccatttttaaaaaagattgggccaggcgcagtggctcatgcctgtaaccccagcactttgggaggctgaggtgggaggattgcttgagcccaggagttcgagccagcagttcaagaccagcctgggaacatgccaaaccttgtctttacaaa

SEQ ID NO: 68735 - DNA, 1637 bp, Homo sapiens
tttagcttccctgaggtaactggtgattagttcctggaaaggcaggagctcagctgggcacaagagagttaagcagagagctggatcctccggggccctgatgcaccctgacgaggagtggttttcaggcaaggaacttatcacaggagtgagtagtggcacacggtgagtagtgctagctgtcttgtcgttagggtgaggccggtgggagttgtggtttggggagtgtagaggagggttgataggctactgagattggagaatcagctttatgtgggtcatggtggtggcagcctgggagatgaacaaggaaactttgcagagtgggcttcctgatggagagtgacctcttactgcgtgggagtgggtgactcagatctgttaggattcctgttgcttgctagggattgtggctgactatattggtggctgaacattgaggtggatgcaactggaagggttatgtggggctggatgagtttgttcccacgtagaggacagtgtggacctttcttactccaagtcagagtggtgactgtcattgacaacattttaagtaaggaatttctttgtggtatttggatccaaagcttttctctgttcatttttttctttcctccgttgtttttgaattgtgactcatactttcttttcagcactgtggctatttgaaatgatagacaaacttagacttcatcatacatgtaagttccaggcgttttcagtccaattcttataaatctaaatttaaaagcttcttttcactaatttgtgtaccattgtttaatgtgtgcaacactaaagaaggataagaaaactctaacatttatgttgttaaatggtctttccatccttaaatccatgaaatttcatcttctcttactgccatgaagtgagttcgttgaatctattaaatcttagtgactctcatttcagcatccttgtttactctcacaggacattgtcttcactagaagtattatccatcttcaatgaatttggcctgtacactgtctccctgtgacaatctatatcattgaaagacagtacgcaaactccaactctgaggcctgcagctgtgggccggagctctgtatgtattattcaggcaaaagttggtgtgttgtctgtaggtgaggtttaaagggaaccctacatgaacaaaaacagtatcagaatcattgtaccttctgagtttagagtggtaggaaatatagcctaactggagtctagtataaactttcaagtgcaatgttaggtaattctgtttgtagttgtactgatagttctcattattgtaaacattatctttttccttaagctttaaataattatttttcttcaatggtattctttctttcttggctgggtgtggtggctaacgcctgtaatcccaacactttgggaggtcgaggcgggcatatcacatgaggtcaggagattgagcctgcatggcgaaaccctgtctctactaaaactacaaaaattagccggtggggtggcatgtgcctgtagtcccagctactctggaggcagagggacaagaatcacttgaatctgggaggcagaggttacaatgagccgagatcgtgccactgcactccagcctcagcgacaaagcgagactctgactcaaa

SEQ ID NO: 68736 - DNA, 567 bp, Homo sapiens
aataggtccatctaattggagccaatgattacctctgagtgtccacctcttgttccacacttttatacttccccaaaggcgtaagtgaaccttatctaaattcaagccatttactgttattttccatcattttacctttgtcttaatttgctaaatacagttaacacttgaacaacacgggtttgaactgtgcggatcgatcaatgcaacctggtacatgggattctaaacaccgtattgagagggccgacttttcttatactcacattccacaggacggacaggcagacttgagtatgcttggattggggtatatgtggtgggtcctggaaccaatcccacgtatatagtatatgggggatgactgtattgcattaactgaaagagctatgattagcaaactaaaaagcggtgtgtaaacactgcttctttataatttatggaaatgttaaataagatcagtccccactgtttacacttattactaacctttattacttgactttgcttctatttcctagccacaatttaaaaaacaaaattaaaatggtatcaacaacaaaagaa

SEQ ID NO: 68737 - DNA, 920 bp, Homo sapiens
gcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgt

SEQ ID NO: 68738 - DNA, 2582 bp, Homo sapiens
cgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttggaaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagcgccaccacctaccccagccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcagaaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattctgtactcaaaattacacatttgtttaaataaatatccacacaaattctcagttacatcaagtagctggtttatatttagattatctcaagtaggggggaataaccatgtgtaggaatt

SEQ ID NO: 68739 - DNA, 2928 bp, Homo sapiens
cgagtgacctcgcgatctggcccggctcccgctcgtcgcaacagcgtgactacagggtatggcggggtccgggcactgtgcggctggacccccagttctggggccacgccgcggaaccgcttactgctgcagcttttggggtcgcccggccgccgctattacagtcttcccccgcatcagaaggttccattgccttctctttcccccacaatgcaggcaggcaccatagcccgttggaaaaaaaaagagggggacaaaatcaatgaaggtgacctaattgcagaggttgaaactgataaagccactgttggatttgagagcctggaggagtgttatatggcaaagatacttgttgctgaaggtaccagggatgttcccatcggagcgatcatctgtatcacagttggcaagcctgaggatattgaggcctttaaaaattatacactggattcctcagcagcacctaccccacaagcggccccagcaccaacccctgctgccactgcttcgccacctacaccttctgctcaggctcctggtagctcatatccccctcacatgcaggtacttcttcctgccctctctcccaccatgaccatgggcacagttcagagatgggaaaaaaaagtgggtgagaagctaagtgaaggagacttactggcagagatagaaactgacaaagccactataggttttgaagtacaggaagaaggttatctggcaaaaatcctggtccctgaaggcacaagagatgtccctctaggaaccccactctgtatcattgtagaaaaagaggcagatatatcagcatttgctgactataggccaaccgaagtaacagatttaaaaccacaagcgccaccacctaccccagccccggtggccgctgttcctccaactccccagcctttagctcctacaccttcagcaccctgcccagctactcctgctggaccaaagggaagggtgtttgttagccctcttgcaaagaagttggcagtagagaaagggattgatcttacacaagtaaaagggacaggaccagatggtagaatcaccaagaaggatatcgactcttttgtgcctagtaaagttgctcctgctccggcagctgttgtgcctcccacaggtcctggaatggcaccagttcctacaggtgtcttcacagatatcccaatcagcaacattcgtcgggttattgcacagcgattaatgcaatcaaagcaaaccatacctcattattacctttctatcgatgtaaatatgggagaagttttgttggtacggaaagaacttaataagatattagaagggagaagcaaaatttctgtcaatgacttcatcataaaagcttcagctttggcatgtttaaaagttcccgaagcaaattcttcttggatggacacagttataagacaaaatcatgttgttgatgtcagtgttgcggtcagtactcctgcaggactcatcacacctattgtgtttaatgcacatataaaaggagtggaaaccattgctaatgatgttgtttctttagcaaccaaagcaagagagggtaaactacagccacatgaattccagggtggcacttttacgatctccaatttaggaatgtttggaattaagaatttctctgctattattaacccacctcaagcatgtattttggcaattggtgcttcagaggataaactggtccctgcagataatgaaaaagggtttgatgtggctagcatgatgtctgttacactcagttgtgatcaccgggtggtggatggagcagttggagcccagtggcttgctgagtttagaaagtaccttgaaaaacctatcactatgttgttgtaactaactcaagaatttctaaactctcccaggtcacactgattcattcttaacaagatatttatatgttattaaacaggtggttctttttattttaaccagttatttttattattgagtctgtccagataagttatttataatgggcattactgaatttttaaaatgccgattacacccaaatattgtgcacatttaataatcagacaccagatttttagctctgtactcctaattaagggacatgtatgtggccttgcctagccctttggtgataagtacttcctctaggaaatgtacgataggtagaattgtggttccctaaagacaagtacataaaggtgaccctgatgaaaccttgaagttctgaaatttaactgcctaaaatgttctccttagatgtgagagaaagagaaatcagaaaaattaattctcttgggggaagggcttgaattgaagctttactttagaatttagccctggtttgaaattttccattacatgatcttggtttatcatcgatgggaagggtagaaaacttcaaggaaaataagtgaaattttaaaagtcagcattttcttagacctcttcagctgattgtttatttttctatgaattcctacacatggttattcccccctacttgagataatctaaatataaaccagctacttgatgtaactgagaatttgtgtggatatttatttaaacaaatgtgtaattttgagtacagaattcaacagttacctccaaaaaagaaacattgttaatataatttaacagaagttgtgaaactaaaattttctaagattaactggtagttcattgtaaatgaacataatgaacagaatttatgactccactgtggaaaatgctatcaaataactaaggaatatatatggaataagtgtacatatgtaaaatattgttactagagttagatatgtgccaaagtccatttatcccaaatcctgtctgaaaaggaggggtacattggtaaacattttggagtgcttaaaaatgccaaaaacaaatggtaatttctactttgataaagtaaaaaagtcaaatgtgtgtaaaaaa

SEQ ID NO: 68740 - DNA, 737 bp, Homo sapiens
tacccacctcaggtagcctagtgatatttgcaaaatcccaatggcccggtccttttctttactgatggccgtgctggtactcagctacaaatccatctgctctctgggctgtgatctgcctcagacccacagcctgcgtaataggagggccttgatactcctggcacaaatgggaagaatctctcctttctcctgcttgaaggacagacatgaattcagattcccggaggaggagtttgatggccaccagttccagaagactcaagccatctctgtcctccatgagatgatccagcagaccttcaatctcttcagcacagaggactcatctgctgcttgggaacagagcctcctagaaaaattttccactgaactttaccagcaactgaatgacctggaagcatgtgtgatacaggaggttggggtggaagagactcccctgatgaatgaggacttcatcctggctgtgaggaaatacttccaaagaatcactctttatctaacagagaagaaatacagcccttgtgcctgggaggttgtcagagcagaaatcatgagatccttctctttttcaacaaacttgaaaaaaggattaaggaggaaggattgaaaactggttcatcatggaaatgattctcattgactaatgcatcatctcacactttcatgagttcttccatttcaaagactcacttctataaccaccacaagttgaatcaaaatttccaaatgttttc

SEQ ID NO: 68741 - DNA, 398 bp, Homo sapiens
ctgttgtattcattcacatagatataatttataataatgcattttgtttattaaaaaatgactgggccaggcagagtggctcatagtggctcatgcctgtaatcccagcactttgggaggctcaggtgggaggattgcttgagcccaggagttcaagaccagcctgggcaacatggcgaaaccctgtctctacaagaaatacaaaaaaatgagctgggactacaggcgcccatcaccacgcccggctaatttttcttgcatttttagtagagatggggtttcaccatgttagccaggatggtctcgatctcctgacctcgtgatccgcctgcctcagcctcccaaagtgctgggattacgggcgtgacgaccacacccggccgctgttgagctttttt

SEQ ID NO: 68742 - DNA, 199 bp, Homo sapiens
actccagcaacaaatttttattcttttacctttttaaaaaatattttttctccttttttccatatcttatttatacaaaagcaggtggaaaaaatgtcgcggtctttctgttgttctaaagagactatcatatttcttttgactttgaaagatttagctgtttttcaggttaatggaaaacccattcaaaattcctttt

SEQ ID NO: 68743 - DNA, 365 bp, Homo sapiens
ctccttggcatcatttagcctagtatatttgaaacagcaaattaactgtcatcctgtgtattcttttatttttttctcactttatagagtaaacattaaaaacaataacaacaacaaaaaccacctcttactatggtctttgttactttatgattctctactgtaatatgattaacatatagccatgcaccatataacatttccgtgaatgacagatcacatacacatccttatattgtagtactgtatttctaccgtaccttttctatcttcagatatgttttgatacacaaatacttaccattgtattataattgcctacagtattcagtacagtaacttgatgtacagtaggtgtatcgtct

SEQ ID NO: 68744 - DNA, 6614 bp, Homo sapiens
  misc_feature (508)..(508): n is a, c, g, or t
  misc_feature (605)..(605): n is a, c, g, or t
  misc_feature (628)..(628): n is a, c, g, or t
  misc_feature (744)..(744): n is a, c, g, or t
  misc_feature (747)..(747): n is a, c, g, or t
  misc_feature (840)..(840): n is a, c, g, or t
  misc_feature (886)..(886): n is a, c, g, or t
  misc_feature (926)..(927): n is a, c, g, or t
  misc_feature (3068)..(3068): n is a, c, g, or t
  misc_feature (3389)..(3389): n is a, c, g, or t
  misc_feature (6294)..(6294): n is a, c, g, or t
actatcctttcaggaatccctaatttcataggcaatttatatgaacaaaactaatgagccttcaaaattccttagtctaaactattcaatagtgtttttaccctaaagcaataattttggtaaagtacataacactaatgtattcataataaaaaaaagtgtcaggaaaggtttaaaatgtaaaggcagtaagtctaaaataacacaattaagaataagaggatattttcctcacactataagatgtgtaagaattcttacaatgttccttttaatatttagtaacactatctaatagtactttttggccgggtgcagtggctcacgcctgtaatcccaacactttgggaggccgaggcgggcggatcacgagttcaggagatcgagatcacagtgaaacaccgtctctactaaaaatacaaaaaattagctgggggcagtggcgggtgcctgtagtcccagctactcgggaggctgaggcaggagaatggcatgaatccgggaggcngagcttgcagtgagccgagatcgcgccactgcactccagcctgggctatagagggagactccgtctcaaaaaaaaaaaaaaaaaaaaaaaaaaagtngaacttttttcttttaaagtaanaaaagtattttgatagtatttttaagtaccatgtttttctttgtatgttactaaaaaccactgtcatgcaaattctagtaatgaaaacaatttaagctccaagtttttcctaccanaanagcctcaggcacagatggccttttttttaatctagttaacaccatatcccaggtcatcatctgattaagcaagagtgcatttccatgaacaanacactattctttgggaaatatccacaacttatattgaaattgctgngccacagcatataaccgctcccttcagtttttttgaaagnntcttttcttgataataggcaattgtgtgggcctcctgagaaaaacactgggttagtgggaagtgatggatgaagaagatttcagtaaaaatttgagcaaatacttctctttagtttccacatactttaatatttaggaacattttgtaatttgtgaaacacactttcagagtaaaaaaataataattactaaaaccaaaaaaacagaaagagaatatacaaaattatcttatgctagggtgataaaaattatgaatatgattgtacatatcagtgaacactgtttcttatataatatattaaatgtataaaatataaatttaacaaatgaaattatgtgtgtagtttttggtaatcttttttgtctattatatattattaaatgcatatcagtagatacacttctaaaatatgattttacaataataaatatcctaccaaccaaaaaaagcccaggaccagatggattcacagctgaattctaccagatgtacagacaagaactggtactattcctgctaaaactattacaaaaaaggaatcatgttaccccactttaaactagactacagagctacagtaacccaaatagtatggtactagtacaaaaacagacacataaaccaatggaacagaatagagaacccagaaataaggccacacacctacaactatctgatctttgacaaagctgcaaaaaacaagcaatggggaaaggattccctatttaataaatggtgctgggataactggctagcaatatgcagaagattgaaattggaccccttccttataccatgtacaaaaatcaacttaagatgattgaagacttaaatgtaaaacccaaaactgtcaaaactctgaaagacaacctaggcaaaaccattctggtcgtaggagatggcaaaagtttcatgatgaagacaccaaaagcaattacagcaaaagcaaaaattgacaaatgggatctaattaaacttaagatcttctgcacagaaaaactatcaatagagtaaacagcctgcaggatgggagaaaatatttgcaaagtatgcacctgttaaaggcctaatattcataatctataagacacctaaacaaatttacaagaaagaaaacaatcccatcaaaagtgagcaaaggacgtgaacagacacttttcaaaagaagacatacatgcagccaaaaagcatatgaaaaaaagctcagtatcactgatcattagagaagtacaaattcaaacaacaatgtgataccatctcacaccagtcagaatggctattgctaaaagtcaaaaaataacagatgctgttgaggttgtggagaaaaaggaacacttttataccattggtgggaatgtaaattagttcaaccattgcggaaagcagtgtggcacttcctcaaagagctaaaaagagaacaaccatttgacccagcaatatcattattgggtatatacccaaaggaatataaattatcctaccataaagatacatggatgtgtttgttcattgcagcactattcacaatagcaaagacgtggaatcaatggcagattgaataaaaaaagtggtacatatacacgatggaatactatgcaatcacaaaagggagcacaatcatgtcctttgctgaaacatggatggagctggaggccactatccctagcaaactaacacagaaacagaaaaccaaatgccacatgttctcacttacaagtgggcactagatgatgagaatacatagacaagaagaggggaacaacatacactggggcctacttgagggtgaagagagggaggagggaggacggaggggattaagaaaaataactattggctacaaggcttagtacctgggcgattaaattatctgtataccaaacccctgtgtcgtgagtttacctatgtaataaaccttcaatatacttaaagtttttaaaaaaatacacataacatttaaaaatatgatttaatgtctaaattatagtttattgtataaatataccataagttcataaatcaatcctctattattgatcatttaggtcattcacaatttttaccattataaaaactcaaggtaattaaatactaatgctaatttttatgttttgccagtataaattcccagaattagaantgctgtatgcacattttaaggcttttgataatttttaagttctttactgttcttaagcacagatctaataaattttggtcacattcctggaataacagtagaaattaattatgtagacacaaatctgacatttctagggttattttccttcccttgaaagtgctccttctcagctgagcactgtggctcacgtctgtaatcccagcactttggggggccaaggcaggcggatcatgaggtcaagagatcaagaccatcctggccaacatggcgaaaccccatctctactaaaaatacaaaaattagctgggtgtggtggcntgcacctgtagtcccaactactcaggaggctgaggcaggagaatagtttgaacttgggaggtggaaattgcagtgagccaagattgtgccactgcactccagcctagcaacagagcaagactccgtcaaaaaaagaaagaaagaaagaaagaaagtgctcctgaacatttcattcattgacaaaagctgttcattcaatgactccatcatctgttgaattcctgttacttgcaaagtgcctgataagtacgggggatacagcagtaagatttttaaatagaggcacaaccctgatagagctagcttacaggctaatgtagaatataaataaataaacaagaattgcaataagtagtgtttctcaatgtatagtcagagatgttgccccaaagatgtattggaatcacccatgaggttattccaaatctaatatccacctttaaaaaaagtatgggaccccagtcaagaaactcaatgatagtaagttagttagtgaaagttttccaagtattaaaaaagaaaaagaaaaatagaaccagtgttaagcatcactgaaaaataatatttcagtactatatttgatgtgatcaagaaattaaagtacataagagggacacctagatcagctttgaggccctaaagattgtgtctcagaagaagtgatatctgagacgatatatgaaaaataaagatgagtagaagctggttaaaaatgagcatgagaggcaaggagaggggactgtccacggcattctgggcagaatcaacagcaaatagaaatgctgaaagtgagaaatagcataccataaaaaatgaatgtaatttagaactgtgggactgttgcacttaaaggtgttttggttgggtagaaacgaggataaaaaagtaaatggagatgataacatgaaggaatttataaacaacttacctagatttacttaagaactttgggaatttattgattggtattaacaagggaatggcacaatcagattagaattttacaaagatcccttggatacagtgtggaaagtggattggagcagggcccagttagaaacagggaggtaaactgcaatgaggctacaagagatgagagtagcatgctgtacagtgatgccggtaggacagaagggcaggggctggtgtttctagtgatgaaattgacaaagctatgtgatttccaggatggggagtgtcggatgggaaacagcaaagggagagccctagaaatctggtttgagcagctgggaaagcagatgcactcaccaagaaaaacgtttgcagagaagccagtagagaggggaggtccagagacactcaagttgaacaagttaccttgagattcctgtgaggtaaacaatggagagcttgaacaagcagttgagcctgaagtttagaaaagaaatgggtggacatagagatggggtgttggaattattattattattattattattgtttttttgagatggagtcttgctgtgtcacccaggctggagtgcagtggtgtgatctcggttcactgcaacctccgcctgccgggttgaagcgattctcctgcctcagcctcccgagtagctgggattacaggcgcccgccatcgtgcccagctaatttttgtattttttagtagagacagggtttcaccattttggccaggctggtctcgaactcctgacctcgtgatccacccacctcagcctcccaaagtgctgggattacaggtgtgagccaacacgcctggccagaattattaatatacatagtaatcaaagccaactgaatgtatgattacttggagaatttaaagaatggaaaaagaatagagcttaggttagaagcccccaaaacatcaatatattaaggacagaagattgctgcaaataatcctgacatgaagtaaccaatgacgtggagtaaccaacaaaataaaaaatacaaaaacaaaacagaaaaagtgcaggtcagaaaaattaagggaggaatatttttatgcccatttgttaaagtttgtggataagatcagacattcctataaaaattttaaaaactattaggtgatctattgaacaattaaaacttaagacacaatggcccttggtcccttaactataattcactattttacatataaagactgctcttcaactaatacaattaaaagcaatctgttaaaaaaatgtataatctttgacatgcttgctgcaaaggggaaaatataacctagcaataagtagctaattgagttcaaatcatcacacaaatattcagtaagcaggctttgtgaaggaaaacgtgatctgagttacaaacagtaaagacactgagtaatgaacagtaaatccacttggcatatgggtgactgaatttaagaaaagcctcagagtaaagattctatatttgcataaatatagcaatattttccctctatgtttctgtgtcacaagaaagtactagacagattttacccaaatgttagagactgtgtttggaatcatttgacttaaactataaattacacagcagagagcaaatgcctgtgggaacaagggcctctgagcagagactggcagtcagctcccagggtagctgcaggcatggattcctaagtgagctacatctcactcacatgtgcaactctgacagcagagctccaggtgggaaagaaacagaaggaactgattgattgatcgattgattgattaatgaatctcctgagcaatgcagtgctggacagcaaagactgaccattgaaagttaacttaggctgaaattattatgctctggaaataatgcagtgaaaataagacatgcattacctttcaaaaaatagataaatatggatttcattcatgcttaacttttgctattctattcattactgcctttgaaacagaactanagaaaggttttttcttcttcacccattcactgaaggttattggtatccaaagttcattttgttcaactttctattcaaatttctagttttcttctccttctggtatcctcactcgtaaccatttctttgcctgttctgaagacccactacaaagaatcccaagactcgttttcttcagcaacatgagatcctcgccaaacctattataatcctatgtattctttctcttccacctacatctatttttttcctttttctgagaagtcattgatttttttcactttgtaagtttcaaataaacctaaaaacaataacaaact

SEQ ID NO: 68745 - DNA, 307 bp, Homo sapiens
tctcaggactgtaagaaagagatttcaaagatccttgaaagggttcgagtgaggccgggttctaatcctggcccttggtcccctgtgatgtaaaacaagcccttcttgggtggggcctgcctgaccgcccctctataaaatgcatgctcatttctcactccagatgcccagggatttttcacaaagactaaaagggggcaccccaaatcatttcatattccacttttccattttctttttggtccttgcagaaaaggagtgactttttaagagcctgggcatattaaaaagtgaagagatgccaaat

SEQ ID NO: 68746 - DNA, 268 bp, Homo sapiens
cacaaactgaatcatttattccttgtggggtcgcagttaaaaccctagactctgaatacagcaccattgttatttgcactacttttagtgcctgtgaagtttctaacgtcagtcactatataaacatttattgaatataaataaataaatgtggctctttaatctcaaagcataaattatttacttgtttttatttctaagatacactcaaaataaactcaacctcaagctgtacttagcaattaagattcttatatttattaccagg

SEQ ID NO: 68747 - DNA, 1353 bp, Homo sapiens
  misc_feature (4)..(5): n is a, c, g, or t
  misc_feature (26)..(26): n is a, c, g, or t
  misc_feature (28)..(29): n is a, c, g, or t
  misc_feature (53)..(54): n is a, c, g, or t
  misc_feature (60)..(60): n is a, c, g, or t
  misc_feature (93)..(94): n is a, c, g, or t
  misc_feature (761)..(761): n is a, c, g, or t
  misc_feature (763)..(763): n is a, c, g, or t
  misc_feature (766)..(766): n is a, c, g, or t
  misc_feature (984)..(984): n is a, c, g, or t
  misc_feature (991)..(991): n is a, c, g, or t
  misc_feature (994)..(994): n is a, c, g, or t
catnnggggacgctctcagctctcantnnctgcccagcttccttcaaaatgtnnactatntcgaaatcctgtgcaagctcagcttggagggtnntcactctacaccctcaggtgcatatgggtcagtcaaagcctacaccaactttgatgctgagggggatgctttgaacattgaaaggaccatcaggacaaaaggtgtgggtaagttcaccattgtcaacattttgaccaacagcaggaatgctcggagagaggatgttgcctttgcctagcagagaaggaccacaaaggaacttacatcagcactgaagtcagccttactggccacctggagacagtcattttgggcctattgaagacacctgctcagtatgatgcttctgagctaaaagcttccatgaaggggctgggaactgaggaggactccctcgttgagatcatctgctcaacaaccaaccaggagctccaggaaattaacagagtctacaaagaaatgtacaaaactgatctggagaaggacattatttcggacacatatggtgacttctgcaagctgatgtttgccctggcaaatgttagaagaccagaggatggctctgtcgttgattatgaactgattgaccaagatgcccgggatttctgtgatgctggagtgaagaggaaaagaactgatgttcccaagtggatcagcatgatgaccgagtagagcatgtcccacctccagaaagtatttgataggtacaagagctacagcccatcangnganagcatcaagaaagaggttaaaggagacctggaaaatgctttcctgaacctggtccagtgcattcagaacaagcccctgtattttgctgattggctgtactactccatgaagggccagggggctcgagataaggtcctgatcagaatcatcgtctcccgcagtgaagtggacatgttgaaaattaggtctgaattcaagagaaagtatggcatgtcccngtactantanatccagcaagacactaagaacgactaccagaaagcactgctgtacctgtgtggtggagatgactgaagcccaacatagcttgagcttccagaaacggtgctccccacgcttccagctaacaggtctagaaaaccagcttgtggctaacagtccctgtggccgtccctgtgaagatgacattagcattgcccccaacctcattttagttgcgtaagcatagcctggctttcctgtctagtctctcctgtaagccaaagaaatgtacattccaagcagttggaagtgaaatctatgatgtgaaacactttgcctcctgtgtactgtgtcataaacagatgaataaactgaatttgtacttt

SEQ ID NO: 68748 - DNA, 2579 bp, Homo sapiens
actgttccgcgggcaccggcagcgcagcgtctccgatagtaagtcgggctgccggccggctcattcccccagggtaactctgagcccccggctccgagctccctcgaggccgcctaccggcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaattacaggctcaaaaaaaac

SEQ ID NO: 68749 - DNA, 934 bp, Homo sapiens
gtaaaaagtgttctgtagtgaggttacatatcaggaacatatgagttgagcagagtaatttggtagtgtaagtcgatgcaaaaatacttctatggtacctattacaagctgaccaagataaaaagaagtatgtaacccactgtgctgtcaagcatcatgattccgggcagttttcattttactgtggattttgctatacttatgcaaggacttacactaacctcctggctgtaaatcaaacaaggtgactgaaagtggcatttatgttttcacaagggacatgcttagaagtgtgaccataaagtcacatcttgtacaatctgctcatgtgtttcatctgtagtaatatagccacaaactggacaagaagctgggtatttgggtttaaaatagattttcttgactctgagcttgtatcagtatttctagcttttgttttgtctgacagtattgcagtcttgaaaatcctgagagctaaaaaactgaaaggaatttttccacaccttgaagtcacagtgttttagagtaaaactattttgtgtacaattgtgtttttaaaatagttagtagatcactatggtatttcaattttctttagttttaattgaaaatgtttgcttttaaaactgataggtattgttggaaagcaggatgaagcctgagccagtggaaaagcttgttacagaaaaaacattttgtgttattgctgtggtgtgcatgatttgcaaagattaagtgcattttctctgtctatactgattattgtatatagaggatgttataaatatacatatacatttttgccattatgtaaatcccatgatttcaactgtaaacatctgtccattggtgtagctttacaaaccattcactgattttgtgtaatttaacaatagatatgaaataaagtttaaattacaggctcaaaaaaaac

SEQ ID NO: 68750 - DNA, 2678 bp, Homo sapiens
actgttccgcgggcaccggcagcgcagcgtctccgatagtaagtcgggctgccggccggctcattcccccagggtaactctgagcccccggctccgagctccctcgaggccgcctaccggcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtggaggatttttcagattctagatgcagcaaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagcc

SEQ ID NO: 68751 - DNA, 1739 bp, Homo sapiens
actgttccgcgggcaccggcagcgcagcgtctccgatagtaagtcgggctgccggccggctcattcccccagggtaactctgagcccccggctccgagctccctcgaggccgcctaccggcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtggaggatttttcagattctagatgcagcaaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagttccgttgaagccgtcagattggcagtagccggggaatgttttctgcataccctcgatagacaagagtcattaat

SEQ ID NO: 68752 - DNA, 2765 bp, Homo sapiens
actgttccgcgggcaccggcagcgcagcgtctccgatagtaagtcgggctgccggccggctcattcccccagggtaactctgagcccccggctccgagctccctcgaggccgcctaccggcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggtggaggatttttcagattctagatgcagcaagtaaggataaacggggttctccaaacactaacgcaggcgccaactctccgtcatccacaaagacccggaacacatctaagagtgggaagaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaaagcgtattgagggactgaattttctggatatggagttgtacagctatgccaaagacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagcc

SEQ ID NO: 68753 - DNA, 2590 bp, Homo sapiens
actgttccgcgggcaccggcagcgcagcgtctccgatagtaagtcgggctgccggccggctcattcccccagggtaactctgagcccccggctccgagctccctcgaggccgcctaccggcgtcgggaacatggatgagaaatccaacaagctgctgctagctttggtgatgctcttcctatttgccgtgatcgtcctccaatacgtgtgccccggcacagaatgccagctcctccgcctgcaggcgttcagctccccggtgccggacccgtaccgctcggaggatgagagctccgccaggttcgtgccccgctacaatttcacccgcggcgacctcctgcgcaaggtagacttcgacatcaagggcgatgacctgatcgtgttcctgcacatccagaagaccgggggcaccactttcggccgccacttggtgcgtaacatccagctggagcagccgtgcgagtgccgcgtgggtcagaagaaatgcacttgccaccggccgggtaagcgggaaacctggctcttctccaggttctccacgggctggagctgcgggttgcacgccgactggaccgagctcaccagctgtgtgccctccgtggtggacggcaagcgcgacgccaggctgagaccgtccaggaacttccactacatcaccatcctccgagacccagtgtcccggtacttgagtgagtggaggcatgtccagagaggggcaacatggaaagcatccctgcatgtctgcgatggaaggcctccaacctccgaagagctgcccagctgctacactggcgatgactggtctggctgccccctcaaagagtttatggactgtccctacaatctagccaacaaccgccaggtgcgcatgctctccgacctgaccctggtaggctgctacaacctctctgtcatgcctgaaaagcaaagaaacaaggtccttctggaaagtgccaagtcaaatctgaagcacatggcgttcttcggcctcactgagtttcagcggaagacccaatatctgtttgagaaaaccttcaacatgaactttatttcgccatttacccagtataataccactagggcctctagtgtagagatcaatgaggaaattcaaacctttttttgcagaggtatcagtttatgaggcagaaagagcatcaggaggccaggcgaaagcgtcaggaacaacgcaaatttctgaagggaaggctccttcagacccatttccagagccagggtcagggccagagccagaatccgaatcagaatcagagtcagaacccaaatccgaatgccaatcagaacctgactcagaatctgatgcagaatctgactcagagtttgagccagaaggagaaccgggaaagcccgaagcagaactcaggcaaggagcagaatgataacaccagcaatggcaccaacgactacataggcagtgtagagaaatggcgttaaatggctcaaaaaggcctgtacatacttctcccaaagcgccactgaaaagatggcatagcttaaaagatgaaagtgtccaaacacatcctgcttccttcattggggaagttttaaaaaaaagtttagatgttgcctttacagttgcctttcaattcagtgttatactgtgtgtaggtaaaacaaatctcaatatggaattaaattgtctttttggggttggactaaatatgaaatccgaaagccaaaccagactcaccagaaattgctgtttagatattttaagaagttcttaaattagttatggagacaaagtgaaaacataaaatgtgaccatttaacttatggctaagaaatggactttaaattattcatgatacactgttaaaacccaatcttggaatcaaatattttttccaggggtgagaataagtataaacataaagcaactaaaatgaaacataaaaccttttattttcttctgattttaacaaggaatctatttaaatagaataacaactgatggtgaatcttaccgagctgtagaaaataaaaaattcctctccaaacatgggtagttttatgtcaaaatattggcttttcaagaacaggactcatatcttgatatttaagagatgtttaaaattttaaactttttctaccttctactgtttaaaggttttacacagggtgtatctcacattaaacaaaacacctttttttcaaaatgaaataccaatgtaaagatctaatttccaggcgctttcagggcactgtaatttcaacaatactggaatcattttggcgctgcttctcattcattttaaggcttctctgaattgtgctcattccaaattaacccatgtatagaatctttcttcatcatctaaatggtgtgttgctgaagttattgtggtatataatcctggattaaagtcaggactttctttctatagaattattttatcaatatttgtgtagtgaggtcctaatcaagaaacttgaacaggataatgtgtctaaaaatattgctgaagttattcttgatcagatagaatttaacctaaaatgtgaactcttacttactttttgtacatctctattgtaatgtttccagttgggccaactatttctagcc

SEQ ID NO: 68754 - DNA, 433 bp, Homo sapiens
taagtgaaaacaagcttattaagcaagtgaaggaataaagaatggctactccataggcagagcagcctggtcaagtgatttaaatagcacctgctttcattctttgcttatcttggcctaccctgatctgtttttcttcttaccacttatcatccttatggcatatttatgcttactgtctgtctcacatcatgaggatgtaagcttcataagagtagaggttttacctgcttttgttcactactgtgtagccagtatgtaggcctggtacacagtagacactcatttgtttcttgcatgtaagtcaggagaaaggccccgcacattatgaagtaataaactggcactttcagtttgatacaagccttctgttatttagataatatgagtctgatcactcacaggaatgcaggaaagtctcatttctggatcc

SEQ ID NO: 68755 - DNA, 4012 bp, Homo sapiens
  misc_feature (2073)..(2073): n is a, c, g, or t
  misc_feature (3158)..(3158): n is a, c, g, or t
  misc_feature (3733)..(3733): n is a, c, g, or t
ggcacgaggcttccgccctgttgtgaagtgggtgtctcggtggagccttggggagcagtcccttttctaggagcctcttgaaggactcaccgtagatgcaggaagacattggatgaggtcagcatagctgaagtgaggtgtctgggttagacaatggctatggccctggaattgcaagcccaggcatctccgcagccagagcctgaagaactcctgattgtgaaactggagctgctcgtgctggagcagttcctgactatcttgcctagggaggtccagacctgggtgcaggcacgccaccctgagagtggtgaggaggctgtggccttggtggaggattggcaccgagagaccaggactgcaggacagtcgggactggaattgcatacagaagagaccaggcccttaaagacaggggaagaagctcagagcttccagctgcagccagtggatccctggcctgagggacagtcccagaagaagggggtgaagaatacatgccctgaccttcccaatcacctaaatgccgaggtggcaccacagcctttgaaagagagtgctgtcctcactccccgagtccctactctcccaaagatggggagcgttggagattgggaggtgacagctgagtcccaggaagccctgggccctggcaaacatgctgagaaggagctctgtaaagaccccccaggagacgactgtgggaacagcgtgtgcctgggagttccagtttcaaaaccaagtaatacctccgagaaagagcaaggaccagagttttggggtctaagtcttataaattctgggaaaaggagcactgcagattacagcctggataatgagccagctcaggcattgacctggagggattcaagagcctgggaggaacaataccagtgggatgtggaggacatgaaggtgtcaggtgttcactggggctatgaggagaccaagactttcctggcaattttgagtgaatctcctttctctgaaaagctccggacttgtcaccagaaccgccaggtatatcgggccattgcagagcagctaagggcaaggggcttcctgcggacactggagcaatgtcgctatagggtcaaaaacctcctacggaattaccggaaagccaagagcagccacccaccaggtacctgccccttctatgaggagctggaggccctggtcagggctcggacagccatcagagccacagatggcccaggagaggccgtggcacttcccaggctcggggatagtgacgcagagatggatgagcaggaggaagggggctgggatcctgaagaaatggcagaagactgtaacggtgctggcctggtcaatgttgagtctacccaggggcccaggattgcaggggccccagctctgttccagagtcgtattgcaggtgtgcactggggctatgaggagaccaaggccttcctggcaattctcagtgagtccccattctcggaaaagcttcgtacctgtcaccagaacagccaggtgtaccgggccattgcagagcggctgtgtgctctgggcttcctgcggacactggagcagtgtcgctacagattcaaaaacctccttcgaagctaccggaaagccaagagcagccacccaccagggacatgccctttctatgaggaactggactcgctgatgagggctcgggctgcagtcagggccatggggactgtccgagaggctgcaggtctccctaggtgtgggcagagtagtgctgagactgatgcccaggaggcctggggtgaagtggccaatgaagatgctgtcaaaccttcaaccttgtgtcctaaagccccagacatgggttttgaaatgaggcatgaggatgaagaccagatttcagagcaggacatttttgagggtttgcctggagccttatcaaaatgtcctacagaagctgtttgccaacctcttgactggggagaagacagtgaaaatgaaaatgaagatgaagggcagtggggaaatccctcacaggaacagtggcaagaaagttcttctgaagaggacttagaaaaacttattgaccatcaaggcctgtaccttgcngagaaaccctacaagtgtgacacatgcatgaagagcttcagtcggagctcccacttcattgcccatcagcgaatccacacaggtgagaagccctacaaatgccttgaatgtggaaaaaactttagtgaccgctctaacctcaatacccatcagagaatccacactggagagaagccctataaatgccttgaatgtgggaaaagctttagtgaccattctaatctcatcactcaccagagaattcacacgggggaaaagccctataaatgtggagaatgttggaaaagcttcaaccagagctcaaaccttctgaaacatcagagaatccacttgggaggaaatcctgaccagtgtagtgagcctgggggaaactttgcccaaagcccatcttttagtgctcactggaggaattctacagaagagacagctcctgaacaacctcaaagtatcagtaaggacttgaattctcctggaccacacagcacaaactcaggggagaaactttatgagtgttctgaatgtggaagaagcttctctaagagctctgccctcattagtcaccaaagaatccatacgggagagaaaccatatgaatgtgccgaatgtgggaaaagcttcagtaagagctccaccctggccaaccaccagcgcacccacactggagagaagccgtataaatgtgtggactgtgggaagtgcttcagtgagcgctccaagctcatcacacaccagagagtgcacacaggagagaagccctacaaatgccttgagtgtggaaaattcttccgtgaccgttctaacctcattactcaccagaggattcatacgggagagaagccgtataagtgcagagagtgtgggaaatgctttaaccagagctccagtcttattattcaccagagaatccacacaggggagaaaccctacaagtgcacagagtgtggcaaagacttcaacaacagttcccacttcagtgctcaccggagaacccatgcaggagggaaggcgtcgtaggggacagtttcctcaacaacaaaggaggactcaatgtatatatcttatatcataagatgtatgctagaganaaactttccaatttttaagcttggtgtgtacccagggaagttatcttggtataaaccaggtaatttggaagtgaattacaaatactaaggatccagatttgaaggcacttttaagtgtaatttgtttttcttctgtaaagacccacacagaatcctgactgtccttgtatttgctatcatgtaagagctgtgtcagtatttgagccaaactggcaacttacgagattagagttaaatcagtggtcctgagcagtgattccaaactctcactgtgccttcacaccatccatgtgtaatccaccccatcagcagtggttctcctactttctcagtgggggcatatcctcaagggagaatgttgtgactctggtgagagaggagttggcctagagcaggccactgtgagctcagcacagagtaggaagaacagtgacatcattacaaaatcatcaatagcagcaatagctggtgtttattgagctgttgctctttggcaagctctgtgctaagaactttgtatacatcatctcatttaatcttcacaacggccccaggagataagtactaactttctncccatttcctagaggcttgggaaattaagtaactcgcactggtcacacatctgtaagtgggagaggcaggattcaacagatctgtctgtcttgagtctatcgtgctcttattgctatactgaattcccattcatgttaggtaacttaggggccagaatctccatgcactttgtagaccacatttcctgttatgaaatttccacattttgaattttttaaacaaatatggaaactgagaatccctaaggattaaaggacttgggatatccaaaaaaaaaa

SEQ ID NO: 68756 - DNA, 470 bp, Homo sapiens
taatgttacacaaattttacataatttatctctttatgaatcaaaaatgttttgaacagtgggactctcattgaaacacttggatcgccaccctgtgttcaacagatggtactcatttggtggtataaatgctggtctacctaccaaactcactctgatggctttctcatcctatttcaagccattttggatcttaaaagagcctgttagcctctggactgcagttgtactcaaaataccaaagtgggtcttactgaattgttgattgggaattttgactatttgtgtgtagggactggaattgcatacagaagagaccaggcccttaaagacaggggaagaagctcagagcttccagctgcagccagtggatccctggcctgagggacagtcccagaagaagggggtgaagaatacatgccctgaccttcccaatcacctaaatgccgaggtggcaccacagcctttga

SEQ ID NO: 68757 - DNA, 2505 bp, Homo sapiens
  misc_feature (1896)..(1896): n is a, c, g, or t
cggacgcgtggggtgaagtgggtgtctcggtggagccttggggagcagtcccttttctaggagcctcttgaaggactcaccgtagatgcaggaagacattggatgaggtcagcatagctgaagtgaggtgtctgggttagacaatggctatggccctggaattgcaagcccaggcatctccgcagccagagcctgaagaactcctgattgtgaaactggaagaggactcttggggatcagaatccaaactctgggagaaggaccgtggctctgtctctggcccagaggcctcccgccagcgcttcaggcaattccaatacagggatgcagctggaccccacgaggccttcagccagctctgggctctctgctgtcgttggctgaggccggagatccgtctcaaagagcagatcctggagctgctcgtgctggagcagttcctgactatcttgcctagggaggtccagacctgggtgcaggcacgccaccctgagagtggtgaggaggctgtggccttggtggaggattggcaccgagagaccaggactgcaggacagtcgggactggaattgcatacagaagagaccaggcccttaaagacaggggaagaagctcagagcttccagctgcagccagtggatccctggcctgagggacagtcccagaagaagggggtgaagaatacatgccctgaccttcccaatcacctaaatgccgaggtggcaccacagcctttgaaagagagtggagttccagtttcaaaaccaagtaatacctccgagaaagagcaaggaccagagttttggggtctaagtcttataaattctgggaaaaggagcactgcagattacagcctggataatgagccagctcaggcattgacctggagggattcaagagcctgggaggaacaataccagtgggatgtggaggacatgaaggtgtcaggtgttcactggggctatgaggagaccaagactttcctggcaattttgagtgaatctcctttctctgaaaagctccggacttgtcaccagaaccgccaggtatatcgggccattgcagagcagctaagggcaaggggcttcctgcggacactggagcaatgtcgctatagggtcaaaaacctcctacggaattaccggaaagccaagagcagccacccaccaggtacctgccccttctatgaggagctggaggccctggtcagggctcggacagccatcagagccacagatggcccaggagaggccgtggcacttcccaggctcggggatagtgacgcagagatggatgagcaggaggaagggggctgggatcctgaagaaatggcagaagactgtaacggtgctggcctggtcaatgttgagtctacccaggggcccaggattgcaggggccccagctctgttccagagtcgtattggtaagaacatgggggtttagtcagattcagatttccaaccctcctaccagctagactgctattccctgaggtcagggcacaggctgcaagtctggattgaagccactagagtgaagagctacattccttaggtcatcctcaaactccaactttcttttcccatgaccaagtctctttgcaaaagtcttcttagttatagaagcaaacatttttaaagccttaaggggcctcaaagagtgaatccagtatttccaaaagtgtgtcactggtagtatgggatgatcatcgacgttacatgaatgaactttaaattcttgtatttatatatttctcttaatttgtatgagtgcatcaacctgtgatttcacagataacaaagttaggtaaagagtgatggcgagtgaaatattgaacagataatggcagaaatcccgacagtgtagacttgaataatcaatgtctgggaaacanccaatcattgtaaaggtgcaaacatggaagtccatgagatgaggcgtcttatagacgcacaggtaggagcagagcccggatcagagcctgtggctcctgcctgccggtttcacatggttttccctccaccatgttgccttcctgggctacatcactttcctgcagaggagctgagactagaccacctccttttcattcccctgcaaaggaggaaagtgtgtcctcatttggcctttcttgcaggactatttgaaactcatttatgcctctaatctttaggaattctcagctttcatgttttgttaaaaggagaatttatggccaggtgcggtggctcacgcctgtaatcccaacactttgggaggctgaggtgggcagatcacgaggtcaggagatcaagactatcctggccaacatggtgaaaccctgtctctactaaaaaaaatacaaaaattagctgggtgtggtggcacgcacctgtaatcccagctactcaggaggctgaggcaggagaattgcttgaacccaggaggcagagattgcagtgagccaggattgcatcactgcactccagcctggcggcaaagcgagactccgtctcaaaaaaaa

SEQ ID NO: 68758 - DNA, 288 bp, Homo sapiens
cagaaaggatagaggataaagtgacttgtagtagtctaacatggatacatgctattcctagttctatgcccttgatgttctctaatggaaagctttcaagaccatctccaaaaatgtctgctttcattttatttatctgaactggctgtttccagtgaactgtggcccgcttcctaggcagagaccatacaatagtttattctctctaaaagctttgagtattcctgtcgttcagggagtagcatgcaagtcctgggaaatggtatttaaacaagctcaacttgacca

SEQ ID NO: 68759 - DNA, 368 bp, Homo sapiens
tcttctcgttttctccagacagcaccttcctttagcttgggcacaaaagagaaaggcaggaagtagacacaatatatgaaatgaagaacttaggccgggcgcggtggctcatgcctgtaatcccagcactttgggaggccgaggcaggtggatcacgaggtcaggagattgacaccatcctggctaacacggtgaaaccctgtctctactaaaaaaaaattagcagggcatggtggcgggcgcctgtagtcccagctactcgggaggctgaggcaggagaatggcttgaacccaggaggcggagcttgcaatgagccgagattgcgccactgcactccagcctgggcgacagagcaagactccatctc

SEQ ID NO: 68760 - DNA, 799 bp, Homo sapiens
gtaaatgcaagtttctaccctttgaccgacatctgtctgtttttctcccctcctagcccccagcaaccacggttctaattctactttgtttccatgagttttgtggcaggagaataggggattagaggaacaggggttcagcaggtgcagccagttcctacaggcaggagagcagcaggtgtggcttacaggtcacgtcttccctcgtgataacaagccacatcagcctctgattgactgcgggccgggtctccactacggccactgattggtcctgagccaatccttcatagcatctaaccaattggaagcctctgaagggcgtctaggggtgttgccgggttccttctagcttattacaaaccttaattggggaggctcttgagctgctggctcgatcccgctcccactctgaattgtcttcaataaatctgtgcttttctattcacaatagcaaagacctggaatcaacccaaatgcccatcaatgatagactggataaagaaaatgtggtgggctgggtgcagtggctcacgcctgtaatcccagaactttgggaggccgaggcaggtggatcacgaggtcaagagatggagattatcctggccaacatggtgagaccccgtctctactaaaaatacaaaaaagcagggtgtggtggcgggtgcctgtagtcccagctactcgggaggctgaggcaggagaatcacttgaacccggaaggcagacgttgcagtgggccaagattacgccactgcactccagcctgggcaacagagtaagactctgtctcaaaaaa

SEQ ID NO: 68761 - DNA, 426 bp, Homo sapiens
agtttccaaaaggtactgtaaaaatgtatgaaaaatggtaaaaactttatagggcactaacatgaacgaagcttgcgggacccctctggttgagtcagggagtgagttgtgagtgaatgtgaagctctaggacattactgtaccctattgtagatgttataaacattgtacacttaggctactctaaattaattttttctttagtaataaattaaccttagtctactgtaacgtttttacttcatgaacttttaaaattttaaaaagctttttgactcttttgtaataatagcttaaaacacaaacacattatacagcctgtatagaagtactcctttatattctataaactttttctatttaattttttaacttcgtaaaaaataagttaaaaatgaagacacagacacacacattagtcaaggc

SEQ ID NO: 68762 - DNA, 425 bp, Homo sapiens
ctaaattctaagtcctaaaatttagtttctcccaaagtggtgctattaatgaacttataaaattctgccttcctgcacctcactgtcgaataagctcagatgctaagcaaaataacttagtataaagtcatttatgtgtagaaagatataatcttcctggcctccttaattttgtcatttctgttcatggagcataagctcataaaacattaaagactatgcaaaaatatttgccacaacatgcctaccatcttgggactgaaatattaagtccacataatgtaatgattaaacaaaattaagatgctattttataagatagcaatctaacagaaaactgtttggaggaaatagtgtagttttgtagtttttggagggttttcttgagacagggtcttgatctgtcactcaagctagagtgcagt

SEQ ID NO: 68763 - DNA, 806 bp, Homo sapiens
ccccggaaaataggacaggtagagccggtggtaatcgggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttgagaaaagatcgatgggatcaccttcctgtctggaggcagagtgaggaggaggcgtccatcaacctcaatgcctaacaagttgcccctgtgaaccttgggctgactttctagccagcccgagcttgctaagctggcggaaaggact

SEQ ID NO: 68764 - DNA, 647 bp, Homo sapiens
tcttactcagcagttacccttttacttgttcatgtttttatttggtttattatgtagctatctggtgatgtggtatttatccagattcttttgtataatcttatccttgtctttcttaggttgtgagggagctgggagtctctcatccgcacttagtaaagcggagcctaagtggctgttcatttggtgctttaaatagtagttgtgctggttcaatctaagaagaagggggcccagctttagctcttttccttacttgggcacctcattcagttttgatgcccacaatactgagtatctcccttgccctttaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68765 - DNA, 1146 bp, Homo sapiens
  misc_feature (6)..(7): n is a, c, g, or t
gaaaannataggctaggtacgaggcctgggtggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68766 - DNA, 1148 bp, Homo sapiens
  misc_feature (18)..(18): n is a, c, g, or t
  misc_feature (31)..(31): n is a, c, g, or t
  misc_feature (33)..(33): n is a, c, g, or t
gaactcataaggcaggtngcaggcctgggtngnggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68767 - DNA, 1159 bp, Homo sapiens
tcgccttacggctaggtgcgggtctgggtgtggactcggccgagggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68768 - DNA, 1327 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggtatggctgcaagactagaaaccaggactagaaactgggggagtagggaggcatgcctaggaaaaggagggatgcaaagagaaggggctttgtgaacatggtgcaaggccaggaattttgggagcaaaaaccaagtatccttgtggttcaagcctgttttcttccatcttcaggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68769 - DNA, 1078 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtgccacttctgatgcagtgcctcttctgagcaggcca

SEQ ID NO: 68770 - DNA, 1139 bp, Homo sapiens
tctgccatggacagatatgtctccccgttggcgcgatgtaggatggcgctgttccccgaacgctgtcctctactgacaccccttctccatgccccgacctggcgtactggtctggatcccggcccgtctgggtgctgatggagcccagtgaccgcctcgtttagcacgtctctcctccattatctaagcgttgtgtcgctgccccggtgagccacggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68771 - DNA, 1300 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaaggtaggtgactgagaagacgccacgggtaatggagtgggcaggttagtaaatcttttccagcttcagagggaaagcatgggcttatatgatctgtttcacctgaggatgggtgagtacctgattgactgttttactttgccctttagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68772 - DNA, 1407 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccaggtctgggcaggggaaatgatggatagcagatgagaaagaaatcaagatttgctttgttgatgtctgacctaatttcttcttgtctacatttcagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgtaaaaaaaaaaaaaaaaaaaaaaaacaaaaaatttgtgcgggcgcggctcgggccccgagaaaagtttttaaaaccatccgtttggggggggggggccccaggggtaggggaccatggggcacagggggtgccgaggggaacccgggggcgaaaaaggggg

SEQ ID NO: 68773 - DNA, 1102 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68774 - DNA, 792 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagtatggtggcagtgtgggctctcagccacccccagtggcaccagagccaggtcctgttccctcttctcccagccaggagcctcccaccaagcgggagtatgaccagtgtcgcatacaggtgctgccattctaattcttatc

SEQ ID NO: 68775 - DNA, 808 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttgagaaaagatcgatgggatcaccttcctgtctggaggcagagtgaggaggaggcgtccatcaacctcaatgcctaacaagttgcccctgtgaaccttgggctgactttctagccagcccgagcttgctaagctggcggaaaggact

SEQ ID NO: 68776 - DNA, 704 bp, Homo sapiens
tactactaaattcagcggccgctcgacaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgtaaaaaaaaaaaaaaaaaaaaaaaacaaaaaatttgtgcgggcgcggctcgggccccgagaaaagtttttaaaaccatccgtttggggggggggggccccaggggtaggggaccatggggcacagggggtgccgaggggaacccgggggcgaaaaaggggg

SEQ ID NO: 68777 - DNA, 773 bp, Homo sapiens
gagatggctgcttctggactcacgtgggtcaccattgcagcagcacgacagcggctacaggaagatgagatgcgccgggctgctgaggagaggcggagggaaaaggccgaggagttagcagccagacaaagagttagagaaaagatcgagagggacaaagcagagagagccaagaaggtaggtgactgagaagacgccacgggtaatggagtgggcaggttagtaaatcttttccagcttcagagggaaagcatgggcttatatgatctgtttcacctgaggatgggtgagtacctgattgactgttttactttgccctttagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68778 - DNA, 623 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaatggaatgggaagatgatcttcccctagagtttggccatccagcagctgatttcctctttgaccacccccagtcgaattcctctcaacattcagacattccttctcttctctctg

SEQ ID NO: 68779 - DNA, 820 bp, Homo sapiens
tcttactcagcagttacccttttacttgttcatgtttttatttggtttattatgtagctatctggtgatgtggtatttatccagattcttttgtataatcttatccttgtctttcttaggttgtgagggagctgggagtctctcatccgcacttagtaaagcggagcctaagtggctgttcatttggtgctttaaatagtagttgtgctggttcaatctaagaagaagggggcccagctttagctcttttccttacttgggcacctcattcagttttgatgcccacaatactgagtatctcccttgccctttaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggtatggctgcaagactagaaaccaggactagaaactgggggagtagggaggcatgcctaggaaaaggagggatgcaaagagaaggggctttgtgaacatggtgcaaggccaggaattttgggagcaaaaaccaagtatccttgtggttcaagcctgttttcttccatcttcaggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68780 - DNA, 1154 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68781 - DNA, 1162 bp, Homo sapiens
  misc_feature (13)..(13): n is a, c, g, or t
ttgcggctgtccncccggggtttgggattcgtcgaccaggcgtcgtaggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68782 - DNA, 1313 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgtaaaaaaaaaaaaaaaaaaaaaaaacaaaaaatttgtgcgggcgcggctcgggccccgagaaaagtttttaaaaccatccgtttggggggggggggccccaggggtaggggaccatggggcacagggggtgccgaggggaacccgggggcgaaaaaggggg

SEQ ID NO: 68783 - DNA, 1301 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgtaaaaaaacaaccacttaaaaaaaaaaactcgggcataaatctcggggggcggacaagagggatcaagggcacggccaaaggttctcggaccccattttggcacaaggggatactgggcgcccaaaggagggaaaatttaaaaccggcg

SEQ ID NO: 68784 - DNA, 1052 bp, Homo sapiens
gtccgcttccttctcggctttcttctcgtcggtgttcccggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68785 - DNA, 977 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68786 - DNA, 1394 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccaggtctgggcaggggaaatgatggatagcagatgagaaagaaatcaagatttgctttgttgatgtctgacctaatttcttcttgtctacatttcagacaaagagttagagaaaagatcgagagggacaaagcagagagagccaagaaggtaggtgactgagaagacgccacgggtaatggagtgggcaggttagtaaatcttttccagcttcagagggaaagcatgggcttatatgatctgtttcacctgaggatgggtgagtacctgattgactgttttactttgccctttagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68787 - DNA, 1058 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaaaaggccgaggagttagcagccagacaaagagttagagaaaagatcgagagggacaaagcagagagagccaagaagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68788 - DNA, 1421 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcgtaagggagttccccaaccccggcctgcgggtgtggggggtcgcggacctgtctcggcctttgccccagcctgaccgtcaccatggctcgtgggcgctattcatggtgtttctgcccccagggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtcagcagcacgacagcggctacaggaagatgagatgcgccgggctgctgaggagaggcggagggaaaaggccgaggagttagcagccagacaaagagttagagaaaagatcgagagggacaaagcagagagagccaagaaggtaggtgactgagaagacgccacgggtaatggagtgggcaggttagtaaatcttttccagcttcagagggaaagcatgggcttatatgatctgtttcacctgaggatgggtgagtacctgattgactgttttactttgccctttagtatggtggcagtgtgggctctcagccacccccagtggcaccagagccaggtcctgttccctcttctcccagccaggagcctcccaccaagcgggagtatgaccagtgtcgcatacaggtcaggctgccagatgggacctcactgacccagacgttccgggcccgggaacagctggcagctgtgaggctctatgtggagctccaccgtggggaggaactaggtgggggccaggaccctgtgcaattgctcagtggcttccccagacgggccttctcagaagctgacatggagcggcctctgcaggagctgggactcgtgccttctgctgttctcattgtggccaagaaatgtcccagctgagggcctttgtcccattgtccctctgtgaccccttcatctttgataaagcactgacatctccttcctaataaatagaccctgagttctgta

SEQ ID NO: 68789 - DNA, 1079 bp, Homo sapiens
  misc_feature (1001)..(1001): n is a, c, g, or t
  misc_feature (1037)..(1037): n is a, c, g, or t
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagaggatgttggagctggtggcccagaagcagcgggagcgtgaagaaagagaggaacgggaggcattggaacgggaacggcagcgcaggagacaagggcaagagttgtccggcgcatctcatcttcctgtagccgctgtcgtgctgctgacaactcttgcccttctctctccactccccgttctctctccaccccgggagtggagagagaaggatgaggaaggaggagggaagggaggaggtggaaggttaacactttaccatgattagggagacctcacctccatcactaatccctgggaagagtatgaaaatggggagaagaaagggtaagaaatcaaacctcagcggttgaacaaagggtcaccgagctatactagtcaagaagcagcttctatgtaactgaccctgaggggataaaaacagggaagattccaccatctcccctgtgacctcagcacctaagcaggcactcgactataggctttccttctccatgattccccaactctatacatcttacttccaaaccccattctaaggtgngctggctcccagggaaaggatcagctcaggcagggnaggacagccccagcagacgtattgacatctctctcactccgg

SEQ ID NO: 68790 - DNA, 689 bp, Homo sapiens
gtccgcttccttctcggctttcttctcgtcggtgttcccggctgctatagagccgggtgagagagcgagcgcccgtcggcgggtgtcgagggcgggttgcctcgcgctgacccttcccgccctccttctcgtcacacaccaggtccccgcggaagccgcggtgtcggcgccatggcggagctgacggctcttgagagtctcatcgagatgggcttccccaggggacgcgcggagaaggctctggccctcacagggaaccaggcatcgaggctgcgatggactggctgatggagcacgaagacgaccccgatgtggacgagcctttagagactccccttggacatatcctgggacgggagcccacttcctcagagcaaggcggccttgaaggatctggttctgctgccggagaaggcaaacccgctttgagtgaagaggaaagacaggaacaaactaagagatgttggagctgctggcccttacgcgccgcccgccgtcgccatctgtttcccttccctcccccatacctagcccgagtctgagccctaacgagaaggctgggcctaggccgctggatgctggagtgacaggaagggagaaagggaaaaagcgggaagagtcgagaagcctgagtgttaacaggccaagtgcgtcgcgcgtgaggggcagcaggtgtatgctctagacac

SEQ ID NO: 68791 - DNA, 930 bp, Homo sapiens
ggctcttcccagctgaagagcaccctcctggagcagcctcttcagcaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaaccacagagaagaaaaactcgacggactaacagcgcggccgcacaaagtcataaggggacaggtaaaatgttcgcgcacacgcttctgcaaagggacatacggaccca

SEQ ID NO: 68792 - DNA, 1647 bp, Homo sapiens
  misc_feature (1640)..(1640): n is a, c, g, or t
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaacaaataaaaaaaaaaaaaaaaaaaaaaaaaaaaaatacaaaaaaaaaaaaaaaaaaaaaaagngggggcg

SEQ ID NO: 68793 - DNA, 1684 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaaccacagagaagaaaaactcgacggactaacagcgcggccgcacaaagtcataaggggacaggtaaaatgttcgcgcacacgcttctgcaaagggacatacggaccca

SEQ ID NO: 68794 - DNA, 2524 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggtgagtacgacaagcgcgatcgcgagggtgactcgggtcgaggcggcagcggtccctgcgctttgcggtcgcccagtccacgccgcctccggatctcctcctagccgagacgccctgtgccgcattcaactgtgggccctgagaacgggggagctctggagggcggacgggctggcaacgcagcggagcccgggtcccggagggcggggcgctcctcaggagctgggcaggccggcagttatcgcagtgtcgagctgctccccgggcgtataggagcgctcggtgtcttcccgacacctgggcgcgccgccaaagagagcagctgggagtccctaccgctggcccggcgcggtgtgcgctccggttcccacctcaccctgcaagccttggggtcctgggcggatggagccggctattccggggctcccaggattctgcctactccgcggcacggcgcagagacggggacttggggaaacagcaggccttcccgacgcatgggtgtggcatttggggttcggattctccaaagccagagtccgggttggggttcttgaagctgccctgctgccattcttgagcgtcgccttagaagtatgccccagtaaggactggtgtgggaagcaggtgcctcaaagttgattttgaccctgcgtgtggtgggcctcggtttcgtctttgcatgaaagaggtcggtcctgaggccccgggctgggtcctgctctgctgtctttgggctcatggccccttcctgtctcaggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68795 - DNA, 3065 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggtgagtacgacaagcgcgatcgcgagggtgactcgggtcgaggcggcagcggtccctgcgctttgcggtcgcccagtccacgccgcctccggatctcctcctagccgagacgccctgtgccgcattcaactgtgggccctgagaacgggggagctctggagggcggacgggctggcaacgcagcggagcccgggtcccggagggcggggcgctcctcaggagctgggcaggccggcagttatcgcagtgtcgagctgctccccgggcgtataggagcgctcggtgtcttcccgacacctgggcgcgccgccaaagagagcagctgggagtccctaccgctggcccggcgcggtgtgcgctccggttcccacctcaccctgcaagccttggggtcctgggcggatggagccggctattccggggctcccaggattctgcctactccgcggcacggcgcagagacggggacttggggaaacagcaggccttcccgacgcatgggtgtggcatttggggttcggattctccaaagccagagtccgggttggggttcttgaagctgccctgctgccattcttgagcgtcgccttagaagtatgccccagtaaggactggtgtgggaagcaggtgcctcaaagttgattttgaccctgcgtgtggtgggcctcggtttcgtctttgcatgaaagaggtcggtcctgaggccccgggctgggtcctgctctgctgtctttgggctcatggccccttcctgtctcaggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggtaaaggaatgttcctgtcccccccggggaaagaaagtgaaaatgaaagcgccctggctgctcctggtgtggtcccatttaaaacgaggttgctgaaggccaggatgcgtgctacccggatgtgtgcccagaaaccctgcagccaagagcagccgcctggaccaccagcctccccttcatccacctggcccagcccagagcccaggcccacgtctggtggtttgtgtcttacgagaggccaggcgggggctgaattctctcggttctcagaaggtcaagccctctgttagcatctcctcgaacagtgggccgggggcaaggtggtgactctgttcagtccttaggatggctggaagccagaaggaggagattatgccgccacagcagggagtgcctttccaggaaagcggctgctggggcagcatgggagcccagtccagggagcgttctggcagagaccattccggaacatggatctgcgccggcggctcccaggagaccttccatctcggagctcctgtggagaccacgtgcctggcaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68796 - DNA, 2305 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggtaaaggaatgttcctgtcccccccggggaaagaaagtgaaaatgaaagcgccctggctgctcctggtgtggtcccatttaaaacgaggttgctgaaggccaggatgcgtgctacccggatgtgtgcccagaaaccctgcagccaagagcagccgcctggaccaccagcctccccttcatccacctggcccagcccagagcccaggcccacgtctggtggtttgtgtcttacgagaggccaggcgggggctgaattctctcggttctcagaaggtcaagccctctgttagcatctcctcgaacagtgggccgggggcaaggtggtgactctgttcagtccttaggatggctggaagccagaaggaggagattatgccgccacagcagggagtgcctttccaggaaagcggctgctggggcagcatgggagcccagtccagggagcgttctggcagagaccattccggaacatggatctgcgccggcggctcccaggagaccttccatctcggagctcctgtggagaccacgtgcctggcaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68797 - DNA, 2162 bp, Homo sapiens
  misc_feature (443)..(443): n is a, c, g, or t
agcgggtaggctcctgcgccttcccagtggtgtgcttcactggctgcctgcatcctggggctcaagtgctgtcgggactgcaagggaaacgctgggtggggcattgggctccgagcagcccccgatgggtgacaggtctctctgctagataccacgaggaacccgaggcccggcgaggagaacggcaaagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgangagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggtaaaggaatgttcctgtcccccccggggaaagaaagtgaaaatgaaagcgccctggctgctcctggtgtggtcccatttaaaacgaggttgctgaaggccaggatgcgtgctacccggatgtgtgcccagaaaccctgcagccaagagcagccgcctggaccaccagcctccccttcatccacctggcccagcccagagcccaggcccacgtctggtggtttgtgtcttacgagaggccaggcgggggctgaattctctcggttctcagaaggtcaagccctctgttagcatctcctcgaacagtgggccgggggcaaggtggtgactctgttcagtccttaggatggctggaagccagaaggaggagattatgccgccacagcagggagtgcctttccaggaaagcggctgctggggcagcatgggagcccagtccagggagcgttctggcagagaccattccggaacatggatctgcgccggcggctcccaggagaccttccatctcggagctcctgtggagaccacgtgcctggcaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68798 - DNA, 1212 bp, Homo sapiens
aaggagaaaatagaaaaattgtaaaaaaaaaggctggtaaggtccggaattcccgggatcccaaacatagccgcgcagcatcgtgaagggctggggccttcactcctctgtggctctggaagagcccgatttcctcaggagtccttaggatggctggaagccagaaggaggagattatgccgccacagcagggagtgcctttccaggaaagcggctgctggggcagcatgggagcccagtccagggagcgttctggcagagaccattccggaacatggatctgcgccggcggctcccaggagaccttccatctcggagctcctgtggagaccacgtgcctggcaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68799 - DNA, 1621 bp, Homo sapiens
  misc_feature (443)..(443): n is a, c, g, or t
agcgggtaggctcctgcgccttcccagtggtgtgcttcactggctgcctgcatcctggggctcaagtgctgtcgggactgcaagggaaacgctgggtggggcattgggctccgagcagcccccgatgggtgacaggtctctctgctagataccacgaggaacccgaggcccggcgaggagaacggcaaagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgangagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68800 - DNA, 1920 bp, Homo sapiens
atggttggctggcacgtagaggaggtggcagggctgggtgagcagcaggagccaggttagtggggaggcccgagctaagcgcaggggcaaattctgcgggtgggagagccaggagggcatggggtgcatggtgagatgaaaacgatgtgtgcttgtgacaaaaagcccagaagaggcagtaaggagggaggagtctatcccttatggagagcacatggacttctgggtgggtgtcctgcagttcccttcctcttgagtctttttaactgggggtccggtgtgtttgtgatcaatgacatgtatgcgtgtgcatgtgtacctttgcaggtacacatgtgtggtgtgtgtgcatttgcttggtgtgcgtgcatttgtgtgtgtgttttgtgtgtgcatgcatgtgtgtgtgtttgtggtaggtttgtgcacacatcctgcatacctttgtgcctgggagtggcatgtgtgtggtgggtgtcgctgtgcatgatggagttgcagccgtggtgcatttgtgagattacctcggtggcctaaattggggattaggagggcatcctcaggtccttcccactgtctgctcgtctgcccacaggcggctgtgccctaaacaggaggaggccattcacgcctcgcctgagttgtgtccaaggtgtgcgtgtggccaggggtccatccgcttccctctagcccagcccctgaacacagctgcagtgcacggccccactcctcagctctgctccccatcccaactcgaagacgctgccctggccctgtgtgtgcagctcatgtggactgggagggcagggcaggtgcaggtcttggggcaagagctggagctgtcttttccttcctgcacagccgcagagcaggtggatggggctgcttccctgcaagggcccagggccaggccccctggggatttattcgtggcttagaagggtggggccagaagcaggcgtagtggggattagggactcagcacccccagctctcagtccagcagacagacccaccccaggctgactacagaggctgcacctcagcaaacaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68801 - DNA, 2678 bp, Homo sapiens
atggttggctggcacgtagaggaggtggcagggctgggtgagcagcaggagccaggttagtggggaggcccgagctaagcgcaggggcaaattctgcgggtgggagagccaggagggcatggggtgcatggtgagatgaaaacgatgtgtgcttgtgacaaaaagcccagaagaggcagtaaggagggaggagtctatcccttatggagagcacatggacttctgggtgggtgtcctgcagttcccttcctcttgagtctttttaactgggggtccggtgtgtttgtgatcaatgacatgtatgcgtgtgcatgtgtacctttgcaggtacacatgtgtggtgtgtgtgcatttgcttggtgtgcgtgcatttgtgtgtgtgttttgtgtgtgcatgcatgtgtgtgtgtttgtggtaggtttgtgcacacatcctgcatacctttgtgcctgggagtggcatgtgtgtggtgggtgtcgctgtgcatgatggagttgcagccgtggtgcatttgtgagattacctcggtggcctaaattggggattaggagggcatcctcaggtccttcccactgtctgctcgtctgcccacaggcggctgtgccctaaacaggaggaggccattcacgcctcgcctgagttgtgtccaaggtgtgcgtgtggccaggggtccatccgcttccctctagcccagcccctgaacacagctgcagtgcacggccccactcctcagctctgctccccatcccaactcgaagacgctgccctggccctgtgtgtgcagctcatgtggactgggagggcagggcaggtgcaggtcttggggcaagagctggagctgtcttttccttcctgcacagccgcagagcaggtggatggggctgcttccctgcaagggcccagggccaggccccctggggatttattcgtggcttagaagggtggggccagaagcaggcgtagtggggattagggactcagcacccccagctctcagtccagcagacagacccaccccaggctgactacagaggctgcacctcagcaaacaggtaggccctgttcttggggaggattcccaccaggcaaaggccagctcccgggccctcacctgccacgtgtccaagctaggatcctgtttgcctttcccttgggggctgggagggaggcctccaaccccctctggcattaccagcatcacagataggagtcccaagtcctatgagaagttcctggaataggtgtagattcagtagatctttacaagaccatatctgcagggcaaggtaccagaggacagaggcggggacagggacacttccattccagacctagcagcccagcactcagcaccatgcatgggagcaaatggctggactcctgggtggggtgggggtctcagagcaggctcccagagggcttggaggtgactccaccaggtggggacggcagctcccaggtagggtgtcatcagagtagacagcattgcttgctagggacccctggggaggctgacagggtcagtgggtttcagttggggggctcccctgctgagaacccagtaaagccggccttccattcgtctcccgtgtgcccagagcctggtctgagggccgccctgtgcatgccggcccttccaacgtggcagagctcagggggaagaacacccaggctctcaggagactctcaggccaatgtctccatccctgggtcagccctttcctgccatgaattcaggaaggcagaggcagctcagcagatggggactagaggccgcactgctatccacagcctctcttctcacccccaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68802 - DNA, 1395 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68803 - DNA, 1618 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacgcctctcttctcacccccaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68804 - DNA, 1275 bp, Homo sapiens
ggtttcacactcctgctgtcctgcgtgctgtgtctcccttccctgggtctgttgagtactgattactgggccacagtgtttctttctgggagaaccctcgccttggaggctgacagggtcagtgggtttcagttggggggctcccctgctgagaacccagtaaagccggccttccattcgtctcccgtgtgcccagagcctggtctgagggccgccctgtgcatgccggcccttccaacgtggcagagctcagggggaagaacacccaggctctcaggagactctcaggccaatgtctccatccctgggtcagccctttcctgccatgaattcaggaaggcagaggcagctcagcagatggggactagaggccgcactgctatccacagcctctcttctcacccccaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68805 - DNA, 1539 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtccccgcccgcgaccggtaccgattcgattt

SEQ ID NO: 68806 - DNA, 3090 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggtgagtacgacaagcgcgatcgcgagggtgactcgggtcgaggcggcagcggtccctgcgctttgcggtcgcccagtccacgccgcctccggatctcctcctagccgagacgccctgtgccgcattcaactgtgggccctgagaacgggggagctctggagggcggacgggctggcaacgcagcggagcccgggtcccggagggcggggcgctcctcaggagctgggcaggccggcagttatcgcagtgtcgagctgctccccgggcgtataggagcgctcggtgtcttcccgacacctgggcgcgccgccaaagagagcagctgggagtccctaccgctggcccggcgcggtgtgcgctccggttcccacctcaccctgcaagccttggggtcctgggcggatggagccggctattccggggctcccaggattctgcctactccgcggcacggcgcagagacggggacttggggaaacagcaggccttcccgacgcatgggtgtggcatttggggttcggattctccaaagccagagtccgggttggggttcttgaagctgccctgctgccattcttgagcgtcgccttagaagtatgccccagtaaggactggtgtgggaagcaggtgcctcaaagttgattttgaccctgcgtgtggtgggcctcggtttcgtctttgcatgaaagaggtcggtcctgaggccccgggctgggtcctgctctgctgtctttgggctcatggccccttcctgtctcaggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggtaaaggaatgttcctgtcccccccggggaaagaaagtgaaaatgaaagcgccctggctgctcctggtgtggtcccatttaaaacgaggttgctgaaggccaggatgcgtgctacccggatgtgtgcccagaaaccctgcagccaagagcagccgcctggaccaccagcctccccttcatccacctggcccagcccagagcccaggcccacgtctggtggtttgtgtcttacgagaggccaggcgggggctgaattctctcggttctcagaaggtcaagccctctgttagcatctcctcgaacagtgggccgggggcaaggtggtgactctgttcagtccttaggatggctggaagccagaaggaggagattatgccgccacagcagggagtgcctttccaggaaagcggctgctggggcagcatgggagcccagtccagggagcgttctggcagagaccattccggaacatggatctgcgccggcggctcccaggagaccttccatctcggagctcctgtggagaccacgtgcctggcaggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggagggataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68807 - DNA, 2549 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggtgagtacgacaagcgcgatcgcgagggtgactcgggtcgaggcggcagcggtccctgcgctttgcggtcgcccagtccacgccgcctccggatctcctcctagccgagacgccctgtgccgcattcaactgtgggccctgagaacgggggagctctggagggcggacgggctggcaacgcagcggagcccgggtcccggagggcggggcgctcctcaggagctgggcaggccggcagttatcgcagtgtcgagctgctccccgggcgtataggagcgctcggtgtcttcccgacacctgggcgcgccgccaaagagagcagctgggagtccctaccgctggcccggcgcggtgtgcgctccggttcccacctcaccctgcaagccttggggtcctgggcggatggagccggctattccggggctcccaggattctgcctactccgcggcacggcgcagagacggggacttggggaaacagcaggccttcccgacgcatgggtgtggcatttggggttcggattctccaaagccagagtccgggttggggttcttgaagctgccctgctgccattcttgagcgtcgccttagaagtatgccccagtaaggactggtgtgggaagcaggtgcctcaaagttgattttgaccctgcgtgtggtgggcctcggtttcgtctttgcatgaaagaggtcggtcctgaggccccgggctgggtcctgctctgctgtctttgggctcatggccccttcctgtctcaggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggagggataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68808 - DNA, 3466 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggtgagtacgacaagcgcgatcgcgagggtgactcgggtcgaggcggcagcggtccctgcgctttgcggtcgcccagtccacgccgcctccggatctcctcctagccgagacgccctgtgccgcattcaactgtgggccctgagaacgggggagctctggagggcggacgggctggcaacgcagcggagcccgggtcccggagggcggggcgctcctcaggagctgggcaggccggcagttatcgcagtgtcgagctgctccccgggcgtataggagcgctcggtgtcttcccgacacctgggcgcgccgccaaagagagcagctgggagtccctaccgctggcccggcgcggtgtgcgctccggttcccacctcaccctgcaagccttggggtcctgggcggatggagccggctattccggggctcccaggattctgcctactccgcggcacggcgcagagacggggacttggggaaacagcaggccttcccgacgcatgggtgtggcatttggggttcggattctccaaagccagagtccgggttggggttcttgaagctgccctgctgccattcttgagcgtcgccttagaagtatgccccagtaaggactggtgtgggaagcaggtgcctcaaagttgattttgaccctgcgtgtggtgggcctcggtttcgtctttgcatgaaagaggtcggtcctgaggccccgggctgggtcctgctctgctgtctttgggctcatggccccttcctgtctcaggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggtaaaggaatgttcctgtcccccccggggaaagaaagtgaaaatgaaagcgccctggctgctcctggtgtggtcccatttaaaacgaggttgctgaaggccaggatgcgtgctacccggatgtgtgcccagaaaccctgcagccaagagcagccgcctggaccaccagcctccccttcatccacctggcccagcccagagcccaggcccacgtctggtggtttgtgtcttacgagaggccaggcgggggctgaattctctcggttctcagaaggtcaagccctctgttagcatctcctcgaacagtgggccgggggcaaggtggtgactctgttcagtccttaggatggctggaagccagaaggaggagattatgccgccacagcagggagtgcctttccaggaaagcggctgctggggcagcatgggagcccagtccagggagcgttctggcagagaccattccggaacatggatctgcgccggcggctcccaggagaccttccatctcggagctcctgtggagaccacgtgcctggcaggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggaggggtgcgtagacctcaaggctgctgagtagtcctagcaccgtgagcaggccaggagcccaaacccaacaggcacacccaccctgcagactgtccgaactcttgcacactcccccccacacagaacctgaggttatcacactcctgctgtcctgcgtgcctgtgtctcccttccctgggtctgttgagtactgataactgggccacagtgtttctttctgggagaaccctcgccttgtaggctcctgcgccttcccagtggtgtgcttcactggctgcctgcatcctggggctcaagtgctgtcgggactgcaagggaaacgctgggtggggcattgggctccgagcagcccccgatgggtgacaggtctctctgctagataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68809 - DNA, 2925 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggtgagtacgacaagcgcgatcgcgagggtgactcgggtcgaggcggcagcggtccctgcgctttgcggtcgcccagtccacgccgcctccggatctcctcctagccgagacgccctgtgccgcattcaactgtgggccctgagaacgggggagctctggagggcggacgggctggcaacgcagcggagcccgggtcccggagggcggggcgctcctcaggagctgggcaggccggcagttatcgcagtgtcgagctgctccccgggcgtataggagcgctcggtgtcttcccgacacctgggcgcgccgccaaagagagcagctgggagtccctaccgctggcccggcgcggtgtgcgctccggttcccacctcaccctgcaagccttggggtcctgggcggatggagccggctattccggggctcccaggattctgcctactccgcggcacggcgcagagacggggacttggggaaacagcaggccttcccgacgcatgggtgtggcatttggggttcggattctccaaagccagagtccgggttggggttcttgaagctgccctgctgccattcttgagcgtcgccttagaagtatgccccagtaaggactggtgtgggaagcaggtgcctcaaagttgattttgaccctgcgtgtggtgggcctcggtttcgtctttgcatgaaagaggtcggtcctgaggccccgggctgggtcctgctctgctgtctttgggctcatggccccttcctgtctcaggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggaggggtgcgtagacctcaaggctgctgagtagtcctagcaccgtgagcaggccaggagcccaaacccaacaggcacacccaccctgcagactgtccgaactcttgcacactcccccccacacagaacctgaggttatcacactcctgctgtcctgcgtgcctgtgtctcccttccctgggtctgttgagtactgataactgggccacagtgtttctttctgggagaaccctcgccttgtaggctcctgcgccttcccagtggtgtgcttcactggctgcctgcatcctggggctcaagtgctgtcgggactgcaagggaaacgctgggtggggcattgggctccgagcagcccccgatgggtgacaggtctctctgctagataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68810 - DNA, 1624 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggagggataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68811 - DNA, 2165 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggaggggtgcgtagacctcaaggctgctgagtagtcctagcaccgtgagcaggccaggagcccaaacccaacaggcacacccaccctgcagactgtccgaactcttgcacactcccccccacacagaacctgaggttatcacactcctgctgtcctgcgtgcctgtgtctcccttccctgggtctgttgagtactgataactgggccacagtgtttctttctgggagaaccctcgccttgtaggctcctgcgccttcccagtggtgtgcttcactggctgcctgcatcctggggctcaagtgctgtcgggactgcaagggaaacgctgggtggggcattgggctccgagcagcccccgatgggtgacaggtctctctgctagataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68812 - DNA, 3079 bp, Homo sapiens
atggttggctggcacgtagaggaggtggcagggctgggtgagcagcaggagccaggttagtggggaggcccgagctaagcgcaggggcaaattctgcgggtgggagagccaggagggcatggggtgcatggtgagatgaaaacgatgtgtgcttgtgacaaaaagcccagaagaggcagtaaggagggaggagtctatcccttatggagagcacatggacttctgggtgggtgtcctgcagttcccttcctcttgagtctttttaactgggggtccggtgtgtttgtgatcaatgacatgtatgcgtgtgcatgtgtacctttgcaggtacacatgtgtggtgtgtgtgcatttgcttggtgtgcgtgcatttgtgtgtgtgttttgtgtgtgcatgcatgtgtgtgtgtttgtggtaggtttgtgcacacatcctgcatacctttgtgcctgggagtggcatgtgtgtggtgggtgtcgctgtgcatgatggagttgcagccgtggtgcatttgtgagattacctcggtggcctaaattggggattaggagggcatcctcaggtccttcccactgtctgctcgtctgcccacaggcggctgtgccctaaacaggaggaggccattcacgcctcgcctgagttgtgtccaaggtgtgcgtgtggccaggggtccatccgcttccctctagcccagcccctgaacacagctgcagtgcacggccccactcctcagctctgctccccatcccaactcgaagacgctgccctggccctgtgtgtgcagctcatgtggactgggagggcagggcaggtgcaggtcttggggcaagagctggagctgtcttttccttcctgcacagccgcagagcaggtggatggggctgcttccctgcaagggcccagggccaggccccctggggatttattcgtggcttagaagggtggggccagaagcaggcgtagtggggattagggactcagcacccccagctctcagtccagcagacagacccaccccaggctgactacagaggctgcacctcagcaaacaggtaggccctgttcttggggaggattcccaccaggcaaaggccagctcccgggccctcacctgccacgtgtccaagctaggatcctgtttgcctttcccttgggggctgggagggaggcctccaaccccctctggcattaccagcatcacagataggagtcccaagtcctatgagaagttcctggaataggtgtagattcagtagatctttacaagaccatatctgcagggcaaggtaccagaggacagaggcggggacagggacacttccattccagacctagcagcccagcactcagcaccatgcatgggagcaaatggctggactcctgggtggggtgggggtctcagagcaggctcccagagggcttggaggtgactccaccaggtggggacggcagctcccaggtagggtgtcatcagagtagacagcattgcttgctagggacccctggggaggctgacagggtcagtgggtttcagttggggggctcccctgctgagaacccagtaaagccggccttccattcgtctcccgtgtgcccagagcctggtctgagggccgccctgtgcatgccggcccttccaacgtggcagagctcagggggaagaacacccaggctctcaggagactctcaggccaatgtctccatccctgggtcagccctttcctgccatgaattcaggaaggcagaggcagctcagcagatggggactagaggccgcactgctatccacagcctctcttctcacccccaggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggaggggtgcgtagacctcaaggctgctgagtagtcctagcaccgtgagcaggccaggagcccaaacccaacaggcacacccaccctgcagactgtccgaactcttgcacactcccccccacacagaacctgaggttatcacactcctgctgtcctgcgtgcctgtgtctcccttccctgggtctgttgagtactgataactgggccacagtgtttctttctgggagaaccctcgccttgtaggctcctgcgccttcccagtggtgtgcttcactggctgcctgcatcctggggctcaagtgctgtcgggactgcaagggaaacgctgggtggggcattgggctccgagcagcccccgatgggtgacaggtctctctgctagataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68813 - DNA, 2000 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggaggggtgcgtagacctcaaggctgctgagtagtcctagcaccgtgagcaggccaggagcccaaacccaacaggcacacccaccctgcagactgtccgaactcttgcacactcccccccacacagaacctgaggttatcacactcctgctgtcctgcgtgcctgtgtctcccttccctgggtctgttgagtactgataactgggccacagtgtttctttctgggagaaccctcgccttgtaggctcctgcgccttcccagtggtgtgcttcactggctgcctgcatcctggggctcaagtgctgtcgggactgcaagggaaacgctgggtggggcattgggctccgagcagcccccgatgggtgacaggtctctctgctagataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68814 - DNA, 752 bp, Homo sapiens
tgtgctcatcccacctgttgtgctcatcccacctgtgtgctattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68815 - DNA, 693 bp, Homo sapiens
  misc_feature (8)..(8): n is a, c, g, or t
  misc_feature (14)..(14): n is a, c, g, or t
  misc_feature (32)..(32): n is a, c, g, or t
ggcacganctcgtncgaattcggcacgaggcngacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68816 - DNA, 1502 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcgggtggacctggacggaaaagaaacacactgtgtttggagagaaaagcgcacgcggtttcccacacatc

SEQ ID NO: 68817 - DNA, 606 bp, Homo sapiens
acctgcctccagcggcaccgctttaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68818 - DNA, 1979 bp, Homo sapiens
  misc_feature (1972)..(1972): n is a, c, g, or t
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggtgggcccatccttgtgcctacctgggcaaggcccaaggggaggcctgggggccaggcctttgttgtccatgaggccactgaggttagatgggacagtcctacccaagcactggcatgagacaccgaggtccacggtggagggagagcaggaagcccagcccttcctggataccagccctcccaactccctttcttcctcactggcaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaacaaaaaaaaaaaaaaaaaaagngggggcg

SEQ ID NO: 68819 - DNA, 1854 bp, Homo sapiens
  misc_feature (1847)..(1847): n is a, c, g, or t
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggtgggcccatccttgtgcctacctgggcaaggcccaaggggaggcctgggggccaggcctttgttgtccatgaggccactgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaacaaaaaaaaaaaaaaaaaaagngggggcg

SEQ ID NO: 68820 - DNA, 1460 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgaggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68821 - DNA, 507 bp, Homo sapiens
atgccaggctctgattgccaccccctttttaggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68822 - DNA, 1517 bp, Homo sapiens
  misc_feature (1500)..(1500): n is a, c, g, or t
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaacaaaaaaancccacccccaaaaacac

SEQ ID NO: 68823 - DNA, 1714 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcacaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68824 - DNA, 1465 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcaaaatcagaagtcaaggacggggctgaggctgctgttgtctcggacccgggccataaaggaccggagagattggcaccctggagggatacgg

SEQ ID NO: 68825 - DNA, 1419 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcactacacgaattcccgagcacaccacgattaaagatcctgaagtca

SEQ ID NO: 68826 - DNA, 1568 bp, Homo sapiens
  misc_feature (1561)..(1561): n is a, c, g, or t
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcgcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaacaaaaaaaaaaaaaaaaaaagngggggcg

SEQ ID NO: 68827 - DNA, 3011 bp, Homo sapiens
  misc_feature (3004)..(3004): n is a, c, g, or t
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggtgagtacgacaagcgcgatcgcgagggtgactcgggtcgaggcggcagcggtccctgcgctttgcggtcgcccagtccacgccgcctccggatctcctcctagccgagacgccctgtgccgcattcaactgtgggccctgagaacgggggagctctggagggcggacgggctggcaacgcagcggagcccgggtcccggagggcggggcgctcctcaggagctgggcaggccggcagttatcgcagtgtcgagctgctccccgggcgtataggagcgctcggtgtcttcccgacacctgggcgcgccgccaaagagagcagctgggagtccctaccgctggcccggcgcggtgtgcgctccggttcccacctcaccctgcaagccttggggtcctgggcggatggagccggctattccggggctcccaggattctgcctactccgcggcacggcgcagagacggggacttggggaaacagcaggccttcccgacgcatgggtgtggcatttggggttcggattctccaaagccagagtccgggttggggttcttgaagctgccctgctgccattcttgagcgtcgccttagaagtatgccccagtaaggactggtgtgggaagcaggtgcctcaaagttgattttgaccctgcgtgtggtgggcctcggtttcgtctttgcatgaaagaggtcggtcctgaggccccgggctgggtcctgctctgctgtctttgggctcatggccccttcctgtctcaggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggtaaaggaatgttcctgtcccccccggggaaagaaagtgaaaatgaaagcgccctggctgctcctggtgtggtcccatttaaaacgaggttgctgaaggccaggatgcgtgctacccggatgtgtgcccagaaaccctgcagccaagagcagccgcctggaccaccagcctccccttcatccacctggcccagcccagagcccaggcccacgtctggtggtttgtgtcttacgagaggccaggcgggggctgaattctctcggttctcagaaggtcaagccctctgttagcatctcctcgaacagtgggccgggggcaaggtggtgactctgttcagtccttaggatggctggaagccagaaggaggagattatgccgccacagcagggagtgcctttccaggaaagcggctgctggggcagcatgggagcccagtccagggagcgttctggcagagaccattccggaacatggatctgcgccggcggctcccaggagaccttccatctcggagctcctgtggagaccacgtgcctggcaggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggagggataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaacaaaaaaaaaaaaaaaaaaagngggggcg

SEQ ID NO: 68828 - DNA, 1708 bp, Homo sapiens
  misc_feature (1701)..(1701): n is a, c, g, or t
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacgcctctcttctcacccccaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggtgggcccatccttgtgcctacctgggcaaggcccaaggggaggcctgggggccaggcctttgttgtccatgaggccactgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaacaaaaaaaaaaaaaaaaaaagngggggcg

SEQ ID NO: 68829 - DNA, 3208 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggtgagtacgacaagcgcgatcgcgagggtgactcgggtcgaggcggcagcggtccctgcgctttgcggtcgcccagtccacgccgcctccggatctcctcctagccgagacgccctgtgccgcattcaactgtgggccctgagaacgggggagctctggagggcggacgggctggcaacgcagcggagcccgggtcccggagggcggggcgctcctcaggagctgggcaggccggcagttatcgcagtgtcgagctgctccccgggcgtataggagcgctcggtgtcttcccgacacctgggcgcgccgccaaagagagcagctgggagtccctaccgctggcccggcgcggtgtgcgctccggttcccacctcaccctgcaagccttggggtcctgggcggatggagccggctattccggggctcccaggattctgcctactccgcggcacggcgcagagacggggacttggggaaacagcaggccttcccgacgcatgggtgtggcatttggggttcggattctccaaagccagagtccgggttggggttcttgaagctgccctgctgccattcttgagcgtcgccttagaagtatgccccagtaaggactggtgtgggaagcaggtgcctcaaagttgattttgaccctgcgtgtggtgggcctcggtttcgtctttgcatgaaagaggtcggtcctgaggccccgggctgggtcctgctctgctgtctttgggctcatggccccttcctgtctcaggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggtaaaggaatgttcctgtcccccccggggaaagaaagtgaaaatgaaagcgccctggctgctcctggtgtggtcccatttaaaacgaggttgctgaaggccaggatgcgtgctacccggatgtgtgcccagaaaccctgcagccaagagcagccgcctggaccaccagcctccccttcatccacctggcccagcccagagcccaggcccacgtctggtggtttgtgtcttacgagaggccaggcgggggctgaattctctcggttctcagaaggtcaagccctctgttagcatctcctcgaacagtgggccgggggcaaggtggtgactctgttcagtccttaggatggctggaagccagaaggaggagattatgccgccacagcagggagtgcctttccaggaaagcggctgctggggcagcatgggagcccagtccagggagcgttctggcagagaccattccggaacatggatctgcgccggcggctcccaggagaccttccatctcggagctcctgtggagaccacgtgcctggcaggcatgtcgggccccaggcctgtggtgctgagcgggccttcgggagctgggaagagcaccctgctgaagaggctgctccaggagcacagcggcatctttggcttcagcgtgtcccgtgagtccagggctctcgtggaggggtgcgtagacctcaaggctgctgagtagtcctagcaccgtgagcaggccaggagcccaaacccaacaggcacacccaccctgcagactgtccgaactcttgcacactcccccccacacagaacctgaggttatcacactcctgctgtcctgcgtgcctgtgtctcccttccctgggtctgttgagtactgataactgggccacagtgtttctttctgggagaaccctcgccttgtaggctcctgcgccttcccagtggtgtgcttcactggctgcctgcatcctggggctcaagtgctgtcgggactgcaagggaaacgctgggtggggcattgggctccgagcagcccccgatgggtgacaggtctctctgctagataccacgaggaacccgaggcccggcgaggagaacggcaaaggtgagtggggtggggccctatggctggagcacccccagtgtgggcagggctgctgggccctgcagctgtgttggctgtgctgcccgtctcctgcccccatcaatccctaatctgtgagatgggtccttgcctccaagggccggtgaactcaatcagggtgtcagcgccacagcgtggtgtcgccttccttgggtacagtgtgagaggccggccaaggcctggggctgtcttcctcccaccttggaggcggccacagtgctgctgtccccagccctgtcctggactcggcacttatcagcacttttgagctgtcttctggagtcctggtaaaaagggctactctgcctgcctgattcaagacaagggacccccttcccaacagcacccccgccccttgccgtgcaacccagtggtctccagtcaccccaccacatcgtcccctctgtaacctga

SEQ ID NO: 68830 - DNA, 2266 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggtgagtacgacaagcgcgatcgcgagggtgactcgggtcgaggcggcagcggtccctgcgctttgcggtcgcccagtccacgccgcctccggatctcctcctagccgagacgccctgtgccgcattcaactgtgggccctgagaacgggggagctctggagggcggacgggctggcaacgcagcggagcccgggtcccggagggcggggcgctcctcaggagctgggcaggccggcagttatcgcagtgtcgagctgctccccgggcgtataggagcgctcggtgtcttcccgacacctgggcgcgccgccaaagagagcagctgggagtccctaccgctggcccggcgcggtgtgcgctccggttcccacctcaccctgcaagccttggggtcctgggcggatggagccggctattccggggctcccaggattctgcctactccgcggcacggcgcagagacggggacttggggaaacagcaggccttcccgacgcatgggtgtggcatttggggttcggattctccaaagccagagtccgggttggggttcttgaagctgccctgctgccattcttgagcgtcgccttagaagtatgccccagtaaggactggtgtgggaagcaggtgcctcaaagttgattttgaccctgcgtgtggtgggcctcggtttcgtctttgcatgaaagaggtcggtcctgaggccccgggctgggtcctgctctgctgtctttgggctcatggccccttcctgtctcaggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaaggtgagtggggtggggccctatggctggagcacccccagtgtgggcagggctgctgggccctgcagctgtgttggctgtgctgcccgtctcctgcccccatcaatccctaatctgtgagatgggtccttgcctccaagggccggtgaactcaatcagggtgtcagcgccacagcgtggtgtcgccttccttgggtacagtgtgagaggccggccaaggcctggggctgtcttcctcccaccttggaggcggccacagtgctgctgtccccagccctgtcctggactcggcacttatcagcacttttgagctgtcttctggagtcctggtaaaaagggctactctgcctgcctgattcaagacaagggacccccttcccaacagcacccccgccccttgccgtgcaacccagtggtctccagtcaccccaccacatcgtcccctctgtaacctga

SEQ ID NO: 68831 - DNA, 1599 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68832 - DNA, 1606 bp, Homo sapiens
  misc_feature (1599)..(1599): n is a, c, g, or t
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaacaaaaaaaaaaaaaaaaaaagngggggcg

SEQ ID NO: 68833 - DNA, 1540 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaaccacacacacaaaaaagagacacaacaaccaacatacagaaacaaacaa

SEQ ID NO: 68834 - DNA, 427 bp, Homo sapiens
tcaccaccaactcccaactccccactggaacccagcagtctcgtatctccatcagtgaggacagtgtgagaaatggtgtctggctcaggcacttggcagcacttgaggggtcctcagatgtctcctgcccagcaaggatctgactaaagcagtcgtgggtgtgggaggggcctgcaggcatgcctgggttgggggcagctggccctgggcaccctggtgcaggtccagtctgccctctggatggcccctcctcttccccagattaattactactttgtaaccagggaggtgatgcagcgtgacatagcagccggcgacttcatcgagcatgccgagttctcggggaacctgtatggcacgaggtgggccatgcgtgggtgtgggtgggctcccagggttgctgttggcaacagggatccaggtagtg

SEQ ID NO: 68835 - DNA, 1764 bp, Homo sapiens
cacaaaaaagtttttaaattttttggtacagaaggggtttccctatgatccccaggctggtctccaattcctggcctcaagcggtcctcccggctcggactcccaaagagctgggatcacagacgtgaaccacgcgcccggccacattccccaattaatggtttttggagagtggccggtttggaacgggctagcggagtcgttcgttagttaggtccctgcagtgtagatggaggacggaaacggcgctgtgacataagcgggaggaggcgggctgaggcagcgctgtgacgtagcagatgaaagccgggcccgcgctgcactgaggtacttctctgagtgacaagcgggacaagtacgccgtgggcggggccggcgggtcgtgatgttagttcgcgctgtgtggaggcgggccggcgtggcgctgtgacgcagcgggagaagacgggctgggagggcgctgtgctgaacgcccctgcggtcgcgacaggccagcgcaggtggaggcggggctagcgaggcactgaggtaagtacttccctaaggggcggggaagaacgagtgagacatgggcggggcagtcgcctcatgacgtcagtctcgcgcgcgggcggaggtgggccggtgcggcgctgtcacgtaggttcagtgggcggaagaggtggccccggatgctgcggcgcccgctggccgggctggctgcggccgccctgggccgggccccaccggacggcttgctctgctctttacctggggttgctgtcgaggaccctgtgcaagactcggccggtttttctttctccctgatggacagacccaaacatagccgcgcagcatcgtgaagggctggggccttcactcctctgtggctctggaagagcccgatttcctcaggaggcatgtcgggccccaggcctgtggtgctgagcgggccttcgggagctgggaagagcaccctgctgaagaggctgctccaggagcacagcggcatctttggcttcagcgtgtcccataccacgaggaacccgaggcccggcgaggagaacggcaaagattactactttgtaaccagggaggtgatgcagcgtgacatagcagccggcgacttcatcgagcatgccgagttctcggggaacctgtatggcacgagcaaggtggcggtgcaggccgtgcaggccatgaaccgcatctgtgtgctggacgtggacctgcagggtgtgcggaacatcaaggccaccgatctgcggcccatctacatctctgtgcagccgccttcactgcacgtgctggagcagcggctgcggcagcgcaacactgaaaccgaggagagcctggtgaagcggctggctgctgcccaggccgacatggagagcagcaaggagcccggcctgtttgatgtggtcatcattaacgacagcctggaccaggcctacgcagagctgaaggaggcgctctctgaggaaatcaagaaagctcaaaggaccggcgcctgaggcttgctgtctgttctcggcaccccgggcccatacaggaccagggcagcagcattgagccacccccttggcaggcgatacggcagctctgtgcccttggccagcatgtggagtggaggagatgctgcccctgtggttggaacatcctggggtgacccccgacccagcctcgctgggctgtcccctgtccctatctctcactctggacccagggctgacatcctaataaaataactgttggattagaaactccaaaaaaaatggaatgtgg

SEQ ID NO: 68836 - DNA, 1068 bp, Homo sapiens
ggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagagctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacctaagaatcaaaaaaacctgttaaga

SEQ ID NO: 68837 - DNA, 995 bp, Homo sapiens
ggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagagctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaaccccttgtccagagcttgagatccggtagagtcgaccg

SEQ ID NO: 68838 - DNA, 1008 bp, Homo sapiens
ggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagagctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaactagccaagggcaagctattattcagcagtgtcccggcactactaacccctgcaacaagccagatgaggaacataaggaagaattataattgtcattatttgtagacaataaaactgcctacctgtaaaacctaagaatcaaaaaaacctgttaaga

SEQ ID NO: 68839 - DNA, 2769 bp, Homo sapiens
cagttcacctggcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggccctaggtccagttacagcctcgcggtctatcagggctgcctttagcctgaacagatccttgcccccctggcgtccagaggctgcctgctggtggtgaccacgtggtgtgtctcctgcagactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccggctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggaccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacctaagaatcaaaaaaacctgttaaga

SEQ ID NO: 68840 - DNA, 2649 bp, Homo sapiens
cagttcacctggcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccggctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggaccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacctaagaatcaaaaaaacctgttaaga

SEQ ID NO: 68841 - DNA, 3444 bp, Homo sapiens
cagttcacctggcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggccctaggtccagttacagcctcgcggtctatcagggctgcctttagcctgaacagatccttgcccccctggcgtccagaggctgcctgctggtggtgaccacgtggtgtgtctcctgcagactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccggctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggtaaggctcccgggggatctctagatca

SEQ ID NO: 68842 - DNA, 3859 bp, Homo sapiens
cagttcacctggcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggccctaggtccagttacagcctcgcggtctatcagggctgcctttagcctgaacagatccttgcccccctggcgtccagaggctgcctgctggtggtgaccacgtggtgtgtctcctgcagactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccggctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgagcctgactttttctccaaactggcagccatgtttaggggcttgatctttcacagcagcaggagcggtaaccgagaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggtgagtgtccctcagcgtgacatgctgagagcagagttctgatggtgtccctccctgctcagctccttccttagcctccaggatgaggtccagaccccttagcaggtattcggctccaaacctccaggaccaggttttggcctttccttacccacacgcctccctgtgccagcactgcctctgggcagaggcgctgctgcatctccgatctctgaaagccctgcgcccacttccctgggcactgtctgtcatccaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatata

SEQ ID NO: 68843 - DNA, 3546 bp, Homo sapiens
cagttcacctggcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggccctaggtccagttacagcctcgcggtctatcagggctgcctttagcctgaacagatccttgcccccctggcgtccagaggctgcctgctggtggtgaccacgtggtgtgtctcctgcagactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccggctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccagcccaccttctacgcacaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatata

SEQ ID NO: 68844 - DNA, 1376 bp, Homo sapiens
  misc_feature (47)..(47): n is a, c, g, or t
cacggggcgaaggccctaaccctgctattcctagctcacgcagtagnggctgcagggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatata

SEQ ID NO: 68845 - DNA, 1556 bp, Homo sapiens
cagttcacctggcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggccctaggtccagttacagcctcgcggtctatcagggctgcctttagcctgaacagatccttgcccccctggcgtccagaggctgcctgctggtggtgaccacgtggtgtgtctcctgcagactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccggctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgagcagaggagacctgagcaagccagg

SEQ ID NO: 68846 - DNA, 882 bp, Homo sapiens
gcattctctaagcctgtgctccaaccccgctcatctcatggctttctttgccccaccagcctgactttttctccaaactggcagccatgtttaggggcttgatctttcacagcagcaggagcggtaaccgagagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatata

SEQ ID NO: 68847 - DNA, 479 bp, Homo sapiens
ccgcttgggcccacatggtgcccgggtgcccttgatctgctggccttgcccccacaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggtgagtagggcccaggagttctgcagagggtatcagacaaaaagaagcccgtccccaccctcaagggctccccgctctgttggcctcccttgcctctttctggactgcatcacctccatgcttggagagggggcaagccattcagagctcttggcacaggaggcaggcatctgctgtccccatcccctggtggaggcagcagtgtaggcaactgggtggagtgtcctactggatcccctgaagaaccgtcagggttacaactcttggggccaaagaaagg

SEQ ID NO: 68848 - DNA, 362 bp, Homo sapiens
gcagacagcttccctatggtcatcttctctccttccctctcctgcgccacccacaggcttctgcgctcccttgtcaacctgaagcaggtcatcattcatgcagcccactatctggtgctgggggacaaggagacctaccactttgaccctgaggcgcccttcctccaagtggtgagcccctcctgggtctgcatggggaccctctggtgtgtgcaggtcccatcccaagagctgctggatgggggtgccgcttctctttttccttccccatccggatgagttctgtgcccagtgcagccgctggtccacacctgggacaggtggggtgggaggaggctgagcccatgatggttcttcccttc

SEQ ID NO: 68849 - DNA, 3528 bp, Homo sapiens
cagttcacctggcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggccctaggtccagttacagcctcgcggtctatcagggctgcctttagcctgaacagatccttgcccccctggcgtccagaggctgcctgctggtggtgaccacgtggtgtgtctcctgcagactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccggctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatata

SEQ ID NO: 68850 - DNA, 2290 bp, Homo sapiens
tgcgaagaaatggtcgcaccctctggttaggggagggccatattgacctctggcctctacagggcctgctgtcccaagggcttcagcgtgccctgtgtgcccgtcccctgaggagcccctcatgtctttctccctggcctacacactctctccagccctaggtccagttacagcctcgcggtctatcagggctgcctttagcctgaacagatccttgcccccctggcgtccagaggctgcctgctggtggtgaccacgtggtgtgtctcctgcagactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccggctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggaccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacctaagaatcaaaaaaacctgttaaga

SEQ ID NO: 68851 - DNA, 1318 bp, Homo sapiens
ggaggctgactagaggacccattaggcgcgtctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatata

SEQ ID NO: 68852 - DNA, 1211 bp, Homo sapiens
ggcgggccagcactcactgtttgcttccccaggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggtgagtgtccctcagcgtgacatgctgagagcagagttctgatggtgtccctccctgctcagctccttccttagcctccaggatgaggtccagaccccttagcaggtattcggctccaaacctccaggaccaggttttggcctttccttacccacacgcctccctgtgccagcactgcctctgggcagaggcgctgctgcatctccgatctctgaaagccctgcgcccacttccctgggcactgtctgtcatccaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatata

SEQ ID NO: 68853 - DNA, 845 bp, Homo sapiens
cagttcacctggcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagaggtatctgcttccagccctttcact

SEQ ID NO: 68854 - DNA, 199 bp, Homo sapiens
ctggagaaaggcagctcctacttgtcagttaaacaaaagaataatccacagccccctttccagtgtgtactttcactgtcatccaacagcccattaccatgtcacagcacagcgtacccttccataggtcactttgtttaaaatgacatggataatgcacatgtcagcaagctgacagtcctggccgtccttcagagat

SEQ ID NO: 68855 - DNA, 635 bp, Homo sapiens
aataaaggccagaacgttgtcctaaatgaatcctttgccttactttaggaccttccttccctctcaaattcaggcataatgtaatatagttgaaagggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68856 - DNA, 547 bp, Homo sapiens
cgcggccgccgacacggcgcgagaagacgacagaagggggcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68857 - DNA, 904 bp, Homo sapiens
gtggggcagaagcagctttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaaaaaaaaaaaaaaagttggggggcgcctgagccagaaaaagttttaaacccatcgctgggccgcggcggccagtatgattagtggaaaattggcataaggggtcccaaggaaaccgggctcagacatgggcgggttcccccataaaaacgcgcggcccgcctctggaacaaccagagggcgcgggcatccggctcacacggcgccgggccgtacccccccgcgggagtaaccaaaagacgatcacacagagaagacgaaaaagcaaaaacgacaagcaaggaagacagtaaacgaaaagtaacacagagcgcgacaaacaaacagcatagtg

SEQ ID NO: 68858 - DNA, 649 bp, Homo sapiens
  misc_feature (530)..(530): n is a, c, g, or t
  misc_feature (538)..(538): n is a, c, g, or t
  misc_feature (540)..(540): n is a, c, g, or t
  misc_feature (544)..(544): n is a, c, g, or t
  misc_feature (552)..(552): n is a, c, g, or t
  misc_feature (554)..(554): n is a, c, g, or t
  misc_feature (556)..(557): n is a, c, g, or t
  misc_feature (564)..(565): n is a, c, g, or t
  misc_feature (583)..(583): n is a, c, g, or t
  misc_feature (585)..(585): n is a, c, g, or t
  misc_feature (589)..(589): n is a, c, g, or t
  misc_feature (596)..(596): n is a, c, g, or t
  misc_feature (598)..(598): n is a, c, g, or t
  misc_feature (604)..(604): n is a, c, g, or t
  misc_feature (607)..(607): n is a, c, g, or t
gtggggcagaagcagctttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaaaaaaaaaaaaaaaaaaaaaaaaaaaaaaaaaaaaaaaaaaaagaaaaaaagaaaccccacttatataaaatatataacaaaaaaaaaattgtaccccctttgccccatgtgttttaaatttgggaangtttttcntngggnccaatttngngnnaatttgnnaaatgcccttaagggggngngttnaaaatanangggccnggnttttaccggggaattggccctggggttacccattcggctttt

SEQ ID NO: 68859 - DNA, 693 bp, Homo sapiens
gtggggcagaagcagctttccggtggcagggtctggggaagcggcggcaggcgccatgtccggccgcgaaggtaagtgttccggaaccgtgaggactgcggggacggcggggtggggaccgggcggcaggggcaggccgaacgtgctcgtgtcgcccacaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaacacaacacacacaaaaaactctccagcgct

SEQ ID NO: 68860 - DNA, 703 bp, Homo sapiens
gtggggcagaagcagctttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaatgacactcccccaccgatactccccacccacacgtaaccccacgctccatcctccaaaaccccgcttgcccaccccacctcacaccacaactctcaaacagtgccgctcccttggccacaacccttggaacccttcccaccctttatgcccgttcgccaatttcattacattggccactcggcctattagaggcggcttaccaactgccgcccgctccaacccatctgcctttgctaacaactctgctttccccaactttactccctccgacacaccccccctttctccgtgctttcgct

SEQ ID NO: 68861 - DNA, 451 bp, Homo sapiens
gtggggcagaagcagctttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagatgggacataatattttgcgtgtggtaaaaaaaaaactcggagagtg

SEQ ID NO: 68862 - DNA, 450 bp, Homo sapiens
cgatgtggaagacagctacgggcagcagtggacctatgagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68863 - DNA, 372 bp, Homo sapiens
aggatccccaactacgcagctatccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaaccgcacactacctcccctcagactccccttgcgggccgcctcgtcccgtcgcccct

SEQ ID NO: 68864 - DNA, 842 bp, Homo sapiens
ttcacccgcctctgcctcccagagtgctcggattacaagcgtgagccacagcacctggccaactttttttttttttttcgtactgcttatattatctctaatatatgcttttttgctttctgagtctttttacttctgggtatgcctagactaaaagataaagtccaggctcttcagtgtgctgttgctccatatgcttttctaactgaatcctccaccttttttacatcttttatgtaggagaaattcattacatttcaaaatatttttcaggcccagcagttctagtactttatgtgcatcataagcattattttacattgatccaactagtgattatttcctccacagttgtttatgcccccatttgagcactgtgagccatgctaggcatgatggagacaaggatggtgggagtgtcatctagggcttcccaagacctctctcccagtgggtttgatccattattgtttacctacccagcactgagatttctagctcttgagattccttttcagaatggtgtaaggggccaggcacagaatgggctgaccataatccaagtgctttgggaggcctaagcaggaggattatttaagactaggagttccatcatcaaagggagaccctgtctacagaaaaaatttaaaattagctgggcgtggtggtggtggcggcccgtttcctgtaatcccagctatttaaaaggctgaggcagcctcgcttaagcccaggagttcaaggtaagaggattatttgagcacgggagttcaggctgtagtgagctgggattgcgccactgtattccagcctgggagatagaatgagaccctatctcaaaa

SEQ ID NO: 68865 - DNA, 188 bp, Homo sapiens
acaaaaattagccgggtatgcgtgcatgcgcctgtaatcccagctatttaaaaggctgaggcagcctcgcttaagcccaggagttcaaggtaagaggattatttgagcacgggagttcaggctgtagtgagctgggattgcgccactgtattccagcctgggagatagaatgagaccctatctcaaaa

SEQ ID NO: 68866 - DNA, 606 bp, Homo sapiens
ttccgaattttaatacgacctcacctatagggaaatttttgcccctcgaggccccaagaattccggccaccgaagggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68867 - DNA, 657 bp, Homo sapiens
  misc_feature (6)..(6): n is a, c, g, or t
  misc_feature (26)..(26): n is a, c, g, or t
  misc_feature (103)..(103): n is a, c, g, or t
  misc_feature (114)..(114): n is a, c, g, or t
  misc_feature (116)..(116): n is a, c, g, or t
  misc_feature (126)..(126): n is a, c, g, or t
aaacgncggccgaaccgatccatttngggcgattggttaccggccccccctcgagtcgacgtttcgattaagctgatttcgattcccgccccgtcgatacggntgcagaagacncngagggggaanggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68868 - DNA, 665 bp, Homo sapiens
aataaaggccagaacgttgtcctaaatgaatcctttgccttactttaggaccttccttccctctcaaattcaggcataatgtaatatagttgaaagggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaacacaacacacacaaaaaactctccagcgct

SEQ ID NO: 68869 - DNA, 901 bp, Homo sapiens
atcctccagaaccatccttgggaaactgtaggggcagtaagggagcgctatagtaatgtctgccagatttagtaaaagaatttaacaagtatgatacagatgggtcaaaatggattaaccagtatactggaatcaatgctatctcaagaaagagttttctatcgatgttggtatgagagattttgggaccgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68870 - DNA, 783 bp, Homo sapiens
aataaaggccagaacgttgtcctaaatgaatcctttgccttactttaggaccttccttccctctcaaattcaggcataatgtaatatagttgaaagggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaataaaaatatatatattatattaaatttaaatttgaaaattatttattaaaataataatatttataataatatttaataatatttattatatattaatagtttaattatgtgggaaaataaatttaattatgtgcaatatattcttttgggggtagtttaaatatttgggggtgggttctacacagtgtacttggtatcggttgtactcactcataatcgccttgtctttc

SEQ ID NO: 68871 - DNA, 502 bp, Homo sapiens
aataaaggccagaacgttgtcctaaatgaatcctttgccttactttaggaccttccttccctctcaaattcaggcataatgtaatatagttgaaagggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaaccaaactaaaaatgcctagaaaactaaaaatccttgt

SEQ ID NO: 68872 - DNA, 486 bp, Homo sapiens
aggatccccaactacgcagctatccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68873 - DNA, 466 bp, Homo sapiens
aagatatcaaaacatttttagaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68874 - DNA, 755 bp, Homo sapiens
  misc_feature (13)..(14): n is a, c, g, or t
ctttcggcacagnncgcggtcaccatgtccggccgcgaaggtggcaagaagaagccactgaaacagcccaagaagcaggccaaggagatggacgaggtgagggcgggcgcggaggcactggcgggtgcgggggcgctgggagacaggcctgagttgaacacgctctgcctctccccaggaagataaggctttcaagcagaaacaaaaagaggagcagaagaaactcgaggagctaaaagcgaaggccgcggggaaggggcccttgggtaagtgggggccgaatggagctcaagctggccaaacgctatgagcacctattgggatgagggcgcgggcatgtctttttcctgcctcctgaactgcgaggtctcgttttccgacgtccgctgcagcgaatggtctctagccagtctaggatttgcagcggcagtaagggccgggagctggaaacgaggtctcctgcctcccaggcagtctgggcttccattccttaggaagagctgcagaaacggaaacagtgaaatgtatttacctcagacgcagattcacagttaagtttctcaaagtctgacgtcgtccgcaatcttttgccccaaattcgtatttcactgccttctagtgtttgaaccttacttgacttagaagtttttttgttttgttttgttttgtttgagacagagtctcactctgtctcccagctgggattgcgccactgtattccagcctgggagatagaatgagaccctatctcaaaa

SEQ ID NO: 68875 - DNA, 520 bp, Homo sapiens
gtactctagagaatctttaaaggcagtccgggtaagtgggggccgaatggagctcaagctggccaaacgctatgagcacctattgggatgagggcgcgggcatgtctttttcctgcctcctgaactgcgaggtctcgttttccgacgtccgctgcagcgaatggtctctagccagtctaggatttgcagcggcagtaagggccgggagctggaaacgaggtctcctgcctcccaggcagtctgggcttccattccttaggaagagctgcagaaacggaaacagtgaaatgtatttacctcagacgcagattcacagttaagtttctcaaagtctgacgtcgtccgcaatcttttgccccaaattcgtatttcactgccttctagtgtttgaaccttacttgacttagaagtttttttgttttgttttgttttgtttgagacagagtctcactctgtctcccagctgggattgcgccactgtattccagcctgggagatagaatgagaccctatctcaaaa

SEQ ID NO: 68876 - DNA, 380 bp, Homo sapiens
gagaatttgcttcataccttggaggcagaggtttgcatgtaggccgagatcgttgtcccttcactgcatccttgggcgacaagagcacagattccatctccgttaaaaaaaataaaaggacttctttttctgtaaaatgggttgatatggcactgaggattaaataacccaatctgtgaagtatacggaagtgtagatctagaccagtgcacagccagccactgcttgtactccatctcatcctcattttacctttacctagaacagacagtatcagtgaagctgctatccatgcttgtgttaaagtgaatgcccaatacaaaagccaggctttactaaggtccacagcaggcccgtggggcttctaccgtaagaactat

SEQ ID NO: 68877 - DNA, 542 bp, Homo sapiens
  misc_feature (13)..(14): n is a, c, g, or t
ctttcggcacagnncgcggtcaccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68878 - DNA, 573 bp, Homo sapiens
gtggggcagaagcagctttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68879 - DNA, 744 bp, Homo sapiens
  misc_feature (13)..(14): n is a, c, g, or t
ctttcggcacagnncgcggtcaccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaaatctcacttattaaattccctacaaaaactggtccgcccccttggccctaagtactctagacttttaaaagattatctgtccgccctcaatccgagcctacttggacattcctccctatagggaccgtataccaataactttctgttggaaaccaacatcgtagttcgaacaactgtgatatacccccttacacgaattaaa

SEQ ID NO: 68880 - DNA, 754 bp, Homo sapiens
ttccgaattttaatacgacctcacctatagggaaatttttgcccctcgaggccccaagaattccggccaccgaagggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaaaataaaaatatatatattatattaaatttaaatttgaaaattatttattaaaataataatatttataataatatttaataatatttattatatattaatagtttaattatgtgggaaaataaatttaattatgtgcaatatattcttttgggggtagtttaaatatttgggggtgggttctacacagtgtacttggtatcggttgtactcactcataatcgccttgtctttc

SEQ ID NO: 68881 - DNA, 761 bp, Homo sapiens
gtggggcagaagcagctttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaacttttgtttatttattataattaagtcttgtattcatatactttcctatgtttctctctcttacattttcttctctatctttatattctctatacttctatatctttgttacctcttttgcactttaatctaactcgctatcttctacaccctcctctactactctccttcctatcattgtccctatttcccttattctccactgtcttctttcttctttttaatggtttgtattttccctactttctttctttcatcttatatctttgctctacttctttcgtctttctcatcattctgtcgttctcctctctacgtgctctctattctctacattcctctttctctttctctcccc

SEQ ID NO: 68882 - DNA, 459 bp, Homo sapiens
gtggggcagaagcagctttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaattctacttattaattcatatttctctattctttttattcctcatcttaaaaaaaaa

SEQ ID NO: 68883 - DNA, 987 bp, Homo sapiens
  misc_feature (732)..(732): n is a, c, g, or t
  misc_feature (740)..(740): n is a, c, g, or t
  misc_feature (742)..(742): n is a, c, g, or t
  misc_feature (746)..(746): n is a, c, g, or t
  misc_feature (754)..(754): n is a, c, g, or t
  misc_feature (756)..(756): n is a, c, g, or t
  misc_feature (758)..(759): n is a, c, g, or t
  misc_feature (766)..(767): n is a, c, g, or t
  misc_feature (785)..(785): n is a, c, g, or t
  misc_feature (787)..(787): n is a, c, g, or t
  misc_feature (791)..(791): n is a, c, g, or t
  misc_feature (798)..(798): n is a, c, g, or t
  misc_feature (800)..(800): n is a, c, g, or t
  misc_feature (806)..(806): n is a, c, g, or t
  misc_feature (809)..(809): n is a, c, g, or t
atcctccagaaccatccttgggaaactgtaggggcagtaagggagcgctatagtaatgtctgccagatttagtaaaagaatttaacaagtatgatacagatgggtcaaaatggattaaccagtatactggaatcaatgctatctcaagaaagagttttctatcgatgttggtatgagagattttgggaccgaaatcttttttcatccagagtttgctaatccagactttacacaacctatctcagaagttgtagatgaagtaattcagaattgtcctattgatgtcagacgtcctctctacaagaatattgtcctctctggaggttcaaccatgttcagggactttggacgtcgcttgcaaagagatttgaaaagaactgtagatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaangtttttcntngggnccaatttngngnnaatttgnnaaatgcccttaagggggngngttnaaaatanangggccnggnttttaaacagggggagtggggaaaccctggggggtcccaatataaaggtgtggggaaaaacccccttttcacagggggggaataaaaaaaaaggggcccacaatcgccttttcaaaaaaattggcccccttttggggagaggaaattatgcgcctttttttttttcccggttttttgt

SEQ ID NO: 68884 - DNA, 562 bp, Homo sapiens
gcccaagctgtcagcactccttgggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68885 - DNA, 663 bp, Homo sapiens
gtggggcagaagcagctttccggtggcagggtctggggaagcggcggcaggcgccatgtccggccgcgaaggtaagtgttccggaaccgtgaggactgcggggacggcggggtggggaccgggcggcaggggcaggccgaacgtgctcgtgtcgcccacaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68886 - DNA, 745 bp, Homo sapiens
gtggggcagaagcagctttccggtggcagggtctggggaagcggcggcaggcgccatgtccggccgcgaaggtaagtgttccggaaccgtgaggactgcggggacggcggggtggggaccgggcggcaggggcaggccgaacgtgctcgtgtcgcccacaggtggcaagaagaagccactgaaacagcccaagaagcaggccaaggagatggacgaggtgagggcgggcgcggaggcactggcgggtgcgggggcgctgggagacaggcctgagttgaacacgctctgcctctccccaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68887 - DNA, 475 bp, Homo sapiens
tagaggatcccatctcaggccaggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaa

SEQ ID NO: 68888 - DNA, 704 bp, Homo sapiens
gtggggcagaagcagctttccggtggcagggtctggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttgggtaagtgggggccgaatggagctcaagctggccaaacgctatgagcacctattgggatgagggcgcgggcatgtctttttcctgcctcctgaactgcgaggtctcgttttccgacgtccgctgcagcgaatggtctctagccagtctaggatttgcagcggcagtaagggccgggagctggaaacgaggtctcctgcctcccaggcagtctgggcttccattccttaggaagagctgcagaaacggaaacagtgaaatgtatttacctcagacgcagattcacagttaagtttctcaaagtctgacgtcgtccgcaatcttttgccccaaattcgtatttcactgccttctagtgtttgaaccttacttgacttagaagtttttttgttttgttttgttttgtttgagacagagtctcactctgtctcccagctgggattgcgccactgtattccagcctgggagatagaatgagaccctatctcaaaa

SEQ ID NO: 68889 - DNA, 666 bp, Homo sapiens
  misc_feature (469)..(469): n is a, c, g, or t
  misc_feature (481)..(481): n is a, c, g, or t
  misc_feature (484)..(484): n is a, c, g, or t
  misc_feature (487)..(487): n is a, c, g, or t
  misc_feature (489)..(489): n is a, c, g, or t
  misc_feature (491)..(491): n is a, c, g, or t
  misc_feature (495)..(495): n is a, c, g, or t
  misc_feature (497)..(499): n is a, c, g, or t
  misc_feature (506)..(507): n is a, c, g, or t
  misc_feature (512)..(512): n is a, c, g, or t
  misc_feature (515)..(515): n is a, c, g, or t
  misc_feature (518)..(518): n is a, c, g, or t
  misc_feature (521)..(522): n is a, c, g, or t
  misc_feature (524)..(524): n is a, c, g, or t
  misc_feature (527)..(527): n is a, c, g, or t
  misc_feature (529)..(529): n is a, c, g, or t
  misc_feature (532)..(532): n is a, c, g, or t
  misc_feature (534)..(535): n is a, c, g, or t
  misc_feature (540)..(540): n is a, c, g, or t
  misc_feature (543)..(543): n is a, c, g, or t
  misc_feature (545)..(546): n is a, c, g, or t
  misc_feature (552)..(552): n is a, c, g, or t
  misc_feature (558)..(558): n is a, c, g, or t
  misc_feature (567)..(567): n is a, c, g, or t
  misc_feature (572)..(572): n is a, c, g, or t
  misc_feature (581)..(581): n is a, c, g, or t
  misc_feature (587)..(587): n is a, c, g, or t
  misc_feature (602)..(602): n is a, c, g, or t
  misc_feature (628)..(628): n is a, c, g, or t
  misc_feature (633)..(633): n is a, c, g, or t
  misc_feature (635)..(635): n is a, c, g, or t
  misc_feature (637)..(637): n is a, c, g, or t
  misc_feature (651)..(652): n is a, c, g, or t
  misc_feature (655)..(655): n is a, c, g, or t
  misc_feature (658)..(658): n is a, c, g, or t
aataaaggccagaacgttgtcctaaatgaatcctttgccttactttaggaccttccttccctctcaaattcaggcataatgtaatatagttgaaagggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaanaaaaatgcttgnctnggngnanaagnannnaatggtnnaaaanggntanagnnantgnangtntnngggcngcntnnacccantgaatnttgatttgncaagntaaacatgnggcccnaatagggcttcctgnccaattgccctatagggggccgaatnacaanancntggccccgggttannaantgnagactggt

SEQ ID NO: 68890 - DNA, 988 bp, Homo sapiens
aataaaggccagaacgttgtcctaaatgaatcctttgccttactttaggaccttccttccctctcaaattcaggcataatgtaatatagttgaaagggggaagcggcggcaggcgccatgtccggccgcgaaggtggcaagaagaagccactgaaacagcccaagaagcaggccaaggagatggacgaggaagataaggctttcaagcagaaacaaaaagaggagcagaagaaactcgaggagctaaaagcgaaggccgcggggaaggggcccttggccacaggtggaattaagaaatctggcaaaaagtaagctgttccttgtgcctgaggagatggtgaccctttatttcatctgtatttaaacctctctattccctgccataacatcttttgccacgtatagctggaattaagtgttgtcttggagctgttgtacatttaagaataaacttttgtaaaaaaagaaaaatcttacagtggctcatcatctctttagttgttttcactaagtcattcctaccataactgtgaatttaaagtaaaaccagctcagaatcttgccagagtctgttctttggtccttgttctaccctaaactttgtatcacctgaaattaaaccaactcatttgaaaaaaaaaaaaaaaaaaaaaaaaaaaaaaaaaaaaaacaaaaaaaagagaaaaaagaggagggagcgagcaaagagaatgaaaagaggaggaagaaggagaaatagtagaagtgttaataaaaaaaagagggggggacaataaatacaacgggggagagaaacaggcaacacacaatgagaaaggcgcgaagaagggagaaataaaaaaggggcgtaaagagtggagtggagaaaaaggagaaacgtgtggagacaaagtggggggggaaaatggacaaataagaaatagggtgaaatatactgggtatgtgacaaagagtaaggggaagaggtgcttattgggagaaaagaaaa

SEQ ID NO: 68891 - DNA, 5475 bp, Homo sapiens
gagagagaaggagaagataatatactgaaaagaagaggaggaggagagcgacgggacgggacgcgagcgggagcgcagccgccctctcggctccgcggcggcgcctcgcaagtccgggaggcgaggggggcccgaggggagacgccgtgacaactttcgtttccctctgagggaattgggaggtcggcggccccaaaagctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggtgggtttgctgagttctctcgttgtttccctggcctctgtgaaggaaaatccactctagtccctacctgcatttctcagccttgcttacctgttgccaacattgggccaacccgaattcttcccaatctttatcttggctgccagcgagatgtcctcaacaaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagaaaagcgagacgcccctcagtccaccctgtgccgactctgctacctcagaggcagcaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttcaagccaaatgtgaatttatttgggttggtagcagagcagcagcaccttcaaattctcagccaaagcagatgtttttgccctttctgcttcactgcatggatacagttggtaaaatgtaataatatggcagaattttataggaaacttcctagggaggtaaattatgggaagattaagaaaggtacaaattgctgaggagaagcaggaaacctgtttccttagtggcttttatcccctcggcatgcgatggggctgatgtttctataattgcctcagactttcacatttactagtagggctgagagaggctttagtgaggaaggaatattcagaataaaacggttgagaaagctgagaagaccattgagttttgatcagttgtgaatagagtgcaaagccatggccaagctgtttttggaaacgctggccggcgtgtcttcagtggaaaaagcaaatcaaaatggagcgagagcaaaggggcgtcctcagtcctcaacctacaatcactgtatggaatcggtcctggcagctgaacataggaggtcactggaacaagtgatagtgcagattggctttcaaacatcctcctggcttgagttttatcagctacaatgtgggtcctcttttgaagccttaattcacaacagcagctttttgggggtggggctgggcgggtgttgtcattgttctttcccttcctgtaagtgtcgctagttgctgcctcgtatctcaggtttttctctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacacaccaaatgtgtaacagttcaccacttccagagtgtggtcatgcccaaaacatgtttaagaaaggaaagcagtagctccttgctaacgatgtttcaggaggtttgggggacttggttttaatgagcttctgtcatttagggcttctcttggccatggtcccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaatacgagaaaagacctatctttgcagccataaactcggtgggaacaccaccactcaagttgccaaaggaggcagtggtgaaacctgtcctgttctcacttaaatgaggatttagctcaaaataaagtggtggtgtcatcaggtttattccgtgttctgtcattcacatggaacaccggatgattagctaacagtttagtgccagccttcattctttactgtgtacgttaaatgcacactacagtgaaaaagcctaagacacttggtaaatattttctagctgactgattccagaacacacaa

SEQ ID NO: 68892 - DNA, 5421 bp, Homo sapiens
gagagagaaggagaagataatatactgaaaagaagaggaggaggagagcgacgggacgggacgcgagcgggagcgcagccgccctctcggctccgcggcggcgcctcgcaagtccgggaggcgaggggggcccgaggggagacgccgtgacaactttcgtttccctctgagggaattgggaggtcggcggccccaaaagctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggtgggtttgctgagttctctcgttgtttccctggcctctgtgaaggaaaatccactctagtccctacctgcatttctcagccttgcttacctgttgccaacattgggccaacccgaattcttcccaatctttatcttggctgccagcgagatgtcctcaacaaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagacaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttcaagccaaatgtgaatttatttgggttggtagcagagcagcagcaccttcaaattctcagccaaagcagatgtttttgccctttctgcttcactgcatggatacagttggtaaaatgtaataatatggcagaattttataggaaacttcctagggaggtaaattatgggaagattaagaaaggtacaaattgctgaggagaagcaggaaacctgtttccttagtggcttttatcccctcggcatgcgatggggctgatgtttctataattgcctcagactttcacatttactagtagggctgagagaggctttagtgaggaaggaatattcagaataaaacggttgagaaagctgagaagaccattgagttttgatcagttgtgaatagagtgcaaagccatggccaagctgtttttggaaacgctggccggcgtgtcttcagtggaaaaagcaaatcaaaatggagcgagagcaaaggggcgtcctcagtcctcaacctacaatcactgtatggaatcggtcctggcagctgaacataggaggtcactggaacaagtgatagtgcagattggctttcaaacatcctcctggcttgagttttatcagctacaatgtgggtcctcttttgaagccttaattcacaacagcagctttttgggggtggggctgggcgggtgttgtcattgttctttcccttcctgtaagtgtcgctagttgctgcctcgtatctcaggtttttctctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacacaccaaatgtgtaacagttcaccacttccagagtgtggtcatgcccaaaacatgtttaagaaaggaaagcagtagctccttgctaacgatgtttcaggaggtttgggggacttggttttaatgagcttctgtcatttagggcttctcttggccatggtcccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaatacgagaaaagacctatctttgcagccataaactcggtgggaacaccaccactcaagttgccaaaggaggcagtggtgaaacctgtcctgttctcacttaaatgaggatttagctcaaaataaagtggtggtgtcatcaggtttattccgtgttctgtcattcacatggaacaccggatgattagctaacagtttagtgccagccttcattctttactgtgtacgttaaatgcacactacagtgaaaaagcctaagacacttggtaaatattttctagctgactgattccagaacacacaa

SEQ ID NO: 68893 - DNA, 3053 bp, Homo sapiens
  misc_feature (152)..(152): n is a, c, g, or t
  misc_feature (188)..(188): n is a, c, g, or t
cgaggcgatctagaggatcccttggtagtcacctttactaatatatttccattatatatgaaatgtgttcattattagaaacttggaagttacagaaatgtagaagagaaactcacccagtgttttcaccatccaaagagtgtgattgtccnagtgatgtgatggttcagtgatgtgatgtgttcacnaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttcaagccaaatgtgaatttatttgggttggtagcagagcagcagcaccttcaaattctcagccaaagcagatgtttttgccctttctgcttcactgcatggatacagttggtaaaatgtaataatatggcagaattttataggaaacttcctagggaggtaaattatgggaagattaagaaaggtacaaattgctgaggagaagcaggaaacctgtttccttagtggcttttatcccctcggcatgcgatggggctgatgtttctataattgcctcagactttcacatttactagtagggctgagagaggctttagtgaggaaggaatattcagaataaaacggttgagaaagctgagaagaccattgagttttgatcagttgtgaatagagtgcaaagccatggccaagctgtttttggaaacgctggccggcgtgtcttcagtggaaaaagcaaatcaaaatggagcgagagcaaaggggcgtcctcagtcctcaacctacaatcactgtatggaatcggtcctggcagctgaacataggaggtcactggaacaagtgatagtgcagattggctttcaaacatcctcctggcttgagttttatcagctacaatgtgggtcctcttttgaagccttaattcacaacagcagctttttgggggtggggctgggcgggtgttgtcattgttctttcccttcctgtaagtgtcgctagttgctgcctcgtatctcaggtttttctctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacacaccaaatgtgtaacagttcaccacttccagagtgtggtcatgcccaaaacatgtttaagaaaggaaagcagtagctccttgctaacgatgtttcaggaggtttgggggacttggttttaatgagcttctgtcatttagggcttctcttggccatggtcccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaatacgagaaaagacctatctttgcagccataaactcggtgggaacaccaccactcaagttgccaaaggaggcagtggtgaaacctgtcctgttctcacttaaatgaggatttagctcaaaataaagtggtggtgtcatcaggtttattccgtgttctgtcattcacatggaacaccggatgattagctaacagtttagtgccagccttcattctttactgtgtacgttaaatgcacactacagtgaaaaagcctaagacacttggtaaatattttctagctgactgattccagaacacacaa

SEQ ID NO: 68894 - DNA, 4526 bp, Homo sapiens
gagagagaaggagaagataatatactgaaaagaagaggaggaggagagcgacgggacgggacgcgagcgggagcgcagccgccctctcggctccgcggcggcgcctcgcaagtccgggaggcgaggggggcccgaggggagacgccgtgacaactttcgtttccctctgagggaattgggaggtcggcggccccaaaagctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagaaaagcgagacgcccctcagtccaccctgtgccgactctgctacctcagaggcagcaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttcaagccaaatgtgaatttatttgggttggtagcagagcagcagcaccttcaaattctcagccaaagcagatgtttttgccctttctgcttcactgcatggatacagttggtaaaatgtaataatatggcagaattttataggaaacttcctagggaggtaaattatgggaagattaagaaaggtacaaattgctgaggagaagcaggaaacctgtttccttagtggcttttatcccctcggcatgcgatggggctgatgtttctataattgcctcagactttcacatttactagtagggctgagagaggctttagtgaggaaggaatattcagaataaaacggttgagaaagctgagaagaccattgagttttgatcagttgtgaatagagtgcaaagccatggccaagctgtttttggaaacgctggccggcgtgtcttcagtggaaaaagcaaatcaaaatggagcgagagcaaaggggcgtcctcagtcctcaacctacaatcactgtatggaatcggtcctggcagctgaacataggaggtcactggaacaagtgatagtgcagattggctttcaaacatcctcctggcttgagttttatcagctacaatgtgggtcctcttttgaagccttaattcacaacagcagctttttgggggtggggctgggcgggtgttgtcattgttctttcccttcctgtaagtgtcgctagttgctgcctcgtatctcaggtttttctctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacaccatctctaatatgacgcccagcacacaagtacagaggctggccaggcgaataaaaaggataagcaaggtaagcggtcacccctggggaacgaggcggccagcgatgggggggatggggtcataatagc

SEQ ID NO: 68895 - DNA, 4450 bp, Homo sapiens
gagagagaaggagaagataatatactgaaaagaagaggaggaggagagcgacgggacgggacgcgagcgggagcgcagccgccctctcggctccgcggcggcgcctcgcaagtccgggaggcgaggggggcccgaggggagacgccgtgacaactttcgtttccctctgagggaattgggaggtcggcggccccaaaagctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagaaaagcgagacgcccctcagtccaccctgtgccgactctgctacctcagaggcagcaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttcaagccaaatgtgaatttatttgggttggtagcagagcagcagcaccttcaaattctcagccaaagcagatgtttttgccctttctgcttcactgcatggatacagttggtaaaatgtaataatatggcagaattttataggaaacttcctagggaggtaaattatgggaagattaagaaaggtacaaattgctgaggagaagcaggaaacctgtttccttagtggcttttatcccctcggcatgcgatggggctgatgtttctataattgcctcagactttcacatttactagtagggctgagagaggctttagtgaggaaggaatattcagaataaaacggttgagaaagctgagaagaccattgagttttgatcagttgtgaatagagtgcaaagccatggccaagctgtttttggaaacgctggccggcgtgtcttcagtggaaaaagcaaatcaaaatggagcgagagcaaaggggcgtcctcagtcctcaacctacaatcactgtatggaatcggtcctggcagctgaacataggaggtcactggaacaagtgatagtgcagattggctttcaaacatcctcctggcttgagttttatcagctacaatgtgggtcctcttttgaagccttaattcacaacagcagctttttgggggtggggctgggcgggtgttgtcattgttctttcccttcctgtaagtgtcgctagttgctgcctcgtatctcaggtttttctcattttgatgtgtcatgtatgttaatgtatgaaatgattaaataaaatcaaaactggtacctgtttatacataaatacgagaaaagacctatctttgcagccataaactcggtgggaacaccaccactcaagttgccaaaggaggcagtggtgaaacctgtcctgttctcacttaaatgaggatttagctcaaaataaagtggtggtgtcatcaggtttattccgtgttctgtcattcacatggaacaccggatgattagctaacagtttagtgccagccttcattctttactgtgtacgttaaatgcacactacagtgaaaaagcctaagacacttggtaaatattttctagctgactgattccagaacacacaa

SEQ ID NO: 68896 - DNA, 1443 bp, Homo sapiens
gagagagaaggagaagataatatactgaaaagaagaggaggaggagagcgacgggacgggacgcgagcgggagcgcagccgccctctcggctccgcggcggcgcctcgcaagtccgggaggcgaggggggcccgaggggagacgccgtgacaactttcgtttccctctgagggaattgggaggtcggcggccccaaaagctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctgctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaatacgagaaaagacctatctttgcagccataaactcggtgggaacaccaccactcaagttgccaaaggaggcagtggtgaaacctgtcctgttctcacttaaatgaggatttagctcaaaataaagtggtggtgtcatcaggtttattccgtgttctgtcattcacatggaacaccggatgattagctaacagtttagtgccagccttcattctttactgtgtacgttaaatgcacactacagtgaaaaagcctaagacacttggtaaatattttctagctgactgattccagaacacacaa

SEQ ID NO: 68897 - DNA, 3498 bp, Homo sapiens
gagagagaaggagaagataatatactgaaaagaagaggaggaggagagcgacgggacgggacgcgagcgggagcgcagccgccctctcggctccgcggcggcgcctcgcaagtccgggaggcgaggggggcccgaggggagacgccgtgacaactttcgtttccctctgagggaattgggaggtcggcggccccaaaagctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggtgggtttgctgagttctctcgttgtttccctggcctctgtgaaggaaaatccactctagtccctacctgcatttctcagccttgcttacctgttgccaacattgggccaacccgaattcttcccaatctttatcttggctgccagcgagatgtcctcaacaaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagaaaagcgagacgcccctcagtccaccctgtgccgactctgctacctcagaggcagcaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttca

SEQ ID NO: 68898 - DNA, 5311 bp, Homo sapiens
gagagagaaggagaagataatatactgaaaagaagaggaggaggagagcgacgggacgggacgcgagcgggagcgcagccgccctctcggctccgcggcggcgcctcgcaagtccgggaggcgaggggggcccgaggggagacgccgtgacaactttcgtttccctctgagggaattgggaggtcggcggccccaaaagctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagaaaagcgagacgcccctcagtccaccctgtgccgactctgctacctcagaggcagcaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttcaagccaaatgtgaatttatttgggttggtagcagagcagcagcaccttcaaattctcagccaaagcagatgtttttgccctttctgcttcactgcatggatacagttggtaaaatgtaataatatggcagaattttataggaaacttcctagggaggtaaattatgggaagattaagaaaggtacaaattgctgaggagaagcaggaaacctgtttccttagtggcttttatcccctcggcatgcgatggggctgatgtttctataattgcctcagactttcacatttactagtagggctgagagaggctttagtgaggaaggaatattcagaataaaacggttgagaaagctgagaagaccattgagttttgatcagttgtgaatagagtgcaaagccatggccaagctgtttttggaaacgctggccggcgtgtcttcagtggaaaaagcaaatcaaaatggagcgagagcaaaggggcgtcctcagtcctcaacctacaatcactgtatggaatcggtcctggcagctgaacataggaggtcactggaacaagtgatagtgcagattggctttcaaacatcctcctggcttgagttttatcagctacaatgtgggtcctcttttgaagccttaattcacaacagcagctttttgggggtggggctgggcgggtgttgtcattgttctttcccttcctgtaagtgtcgctagttgctgcctcgtatctcaggtttttctctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacacaccaaatgtgtaacagttcaccacttccagagtgtggtcatgcccaaaacatgtttaagaaaggaaagcagtagctccttgctaacgatgtttcaggaggtttgggggacttggttttaatgagcttctgtcatttagggcttctcttggccatggtcccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaatacgagaaaagacctatctttgcagccataaactcggtgggaacaccaccactcaagttgccaaaggaggcagtggtgaaacctgtcctgttctcacttaaatgaggatttagctcaaaataaagtggtggtgtcatcaggtttattccgtgttctgtcattcacatggaacaccggatgattagctaacagtttagtgccagccttcattctttactgtgtacgttaaatgcacactacagtgaaaaagcctaagacacttggtaaatattttctagctgactgattccagaacacacaa

SEQ ID NO: 68899 - DNA, 5414 bp, Homo sapiens
gagagagaaggagaagataatatactgaaaagaagaggaggaggagagcgacgggacgggacgcgagcgggagcgcagccgccctctcggctccgcggcggcgcctcgcaagtccgggaggcgaggggggcccgaggggagacgccgtgacaactttcgtttccctctgagggaattgggaggtcggcggccccaaaagctttcagtccagtgtaaagctgttggagcgcgggagcaaaggtaaagaatgatgtaatgcgctggctgctccaaagcatcttttgttgtggaatggttattccagtcatctctttatgaatcaaatgtgaggggctgctttgtggacggagtcctttgcaagagcacatcaacgggaaagagaaagagacattcacttggagggctcttgctgaaaatgggtttaactctccttttgccagtcaccaccagcctgacctcatacacttttagtacaatggagtggctgagcctttgagcacaccaccattacatcatcgtggcaaattaaagaaggaggtgggaaaagaggacttattgttgtcatggcccatgagatgattggaactcaaattgttactgagaggttggtggctctgctggaaagtggaacggaaaaagtgctgctaattgatagccggccatttgtggaatacaatacatcccacattttggaagccattaatatcaactgctccaagcttatgaagcgaaggttgcaacaggacaaagtgttaattacagagctcatccagcattcagcgaaacataaggttgacattgattgcagtcagaaggttgtagtttacgatcaaagctcccaagatgttgcctctctctcttcagactgttttctcactgtacttctgggtaaactggagaagagcttcaactctgttcacctgcttgcaggagctgatgcagcagaatgggattggttatgtgttaaatgccagcaatacctgtccaaagcctgactttatccccgagtctcatttcctgcgtgtgcctgtgaatgacagcttttgtgagaaaattttgccgtggttggacaaatcagtagatttcattgagaaagcaaaagcctccaatggatgtgttctagtgcactgtttagctgggatctcccgctccgccaccatcgctatcgcctacatcatgaagaggatggacatgtctttagatgaagcttacagatttgtgaaagaaaaaagacctactatatctccaaacttcaattttctgggccaactcctggactatgagaagaagattaagaaccagactggagcatcagggccaaagagcaaactcaagctgctgcacctggagaagccaaatgaacctgtccctgctgtctcagagggtggacagaaaagcgagacgcccctcagtccaccctgtgccgactctgctacctcagaggcagcaggacaaaggcccgtgcatcccgccagcgtgcccagcgtgcccagcgtgcagccgtcgctgttagaggacagcccgctggtacaggcgctcagtgggctgcacctgtccgcagacaggctggaagacagcaataagctcaagcgttccttctctctggatatcaaatcagtttcatattcagccagcatggcagcatccttacatggcttctcctcatcagaagatgctttggaatactacaaaccttccactactctggatgggaccaacaagctatgccagttctcccctgttcaggaactatcggagcagactcccgaaaccagtcctgataaggaggaagccagcatccccaagaagctgcagaccgccaggccttcagacagccagagcaagcgattgcattcggtcagaaccagcagcagtggcaccgcccagaggtcccttttatctccactgcatcgaagtgggagcgtggaggacaattaccacaccagcttccttttcggcctttccaccagccagcagcacctcacgaagtctgctggcctgggccttaagggctggcactcggatatcttggccccccagacctctaccccttccctgaccagcagctggtattttgccacagagtcctcacacttctactctgcctcagccatctacggaggcagtgccagttactctgcctacagctgcagccagctgcccacttgcggagaccaagtctattctgtgcgcaggcggcagaagccaagtgacagagctgactcgcggcggagctggcatgaagagagcccctttgaaaagcagtttaaacgcagaagctgccaaatggaatttggagagagcatcatgtcagagaacaggtcacgggaagagctggggaaagtgggcagtcagtctagcttttcgggcagcatggaaatcattgaggtctcctgagaagaaagacacttgtgacttctatagacaatttttttttcttgttcacaaaaaaattccctgtaaatctgaaatatatatatgtacatacatatatatttttggaaaatggagctatggtgtaaaagcaacaggtggatcaacccagttgttactctcttaacatctgcatttgagagatcagctaatacttctctcaacaaaaatggaagggcagatgctagaatcccccctagacggaggaaaaccattttattcagtgaattacacatcctcttgttcttaaaaaagcaagtgtctttggtgttggaggacaaaatcccctaccattttcacgttgtgctactaagagatctcaaatattagtctttgtccggacccttccatagtacaccttagcgctgagactgagccagcttgggggtcaggtaggtagaccctgttagggacagagcctagtggtaaatccaagagaaatgatcctatccaaagctgattcacaaacccacgctcacctgacagccgagggacacgagcatcactctgctggacggaccattaggggccttgccaaggtctaccttagagcaaacccagtacctcagacaggaaagtcggggctttgaccactaccatatctggtagcccattttctaggcattgtgaataggtaggtagctagtcacacttttcagaccaattcaaactgtctatgcacaaaattcccgtgggcctagatggagataatttttttttcttctcagctttatgaagagaagggaaactgtctaggattcagctgaaccaccaggaacctggcaacatcacgatttaagctaaggttgggaggctaacgagtctacctccctctttgtaaatcaaagaattgtttaaaatgggattgtcaatcctttaaataaagatgaacttggtttcaagccaaatgtgaatttatttgggttggtagcagagcagcagcaccttcaaattctcagccaaagcagatgtttttgccctttctgcttcactgcatggatacagttggtaaaatgtaataatatggcagaattttataggaaacttcctagggaggtaaattatgggaagattaagaaaggtacaaattgctgaggagaagcaggaaacctgtttccttagtggcttttatcccctcggcatgcgatggggctgatgtttctataattgcctcagactttcacatttactagtagggctgagagaggctttagtgaggaaggaatattcagaataaaacggttgagaaagctgagaagaccattgagttttgatcagttgtgaatagagtgcaaagccatggccaagctgtttttggaaacgctggccggcgtgtcttcagtggaaaaagcaaatcaaaatggagcgagagcaaaggggcgtcctcagtcctcaacctacaatcactgtatggaatcggtcctggcagctgaacataggaggtcactggaacaagtgatagtgcagattggctttcaaacatcctcctggcttgagttttatcagctacaatgtgggtcctcttttgaagccttaattcacaacagcagctttttgggggtggggctgggcgggtgttgtcattgttctttcccttcctgtaagtgtcgctagttgctgcctcgtatctcaggtttttctctgtttttgagaaatggacagttttttgaccaggatgtgacttcatgtttcctatggtgacttctaaaaccagcacagaatgatatgactcaacacagaccgacttggttatggggatgatgagccgcacagacctcactagttgtgcacaaataatgtgctatgatggggtgtaaagtgaaggcagaagagggtcagccgcattgttatgatactgggaaagtgctggtcaacgatttgagttagtttttagatatacattgaaatctttaatcagacattctcaagtttcacacagtagtttttgatgttatgtacacacacaccaaatgtgtaacagttcaccacttccagagtgtggtcatgcccaaaacatgtttaagaaaggaaagcagtagctccttgctaacgatgtttcaggaggtttgggggacttggttttaatgagcttctgtcatttagggcttctcttggccatggtcccccttccttctggaactgtgatgtagtcacatcctacagcctttagtgctggttcactagtgtcagataatcagttcttggaatcgagactgccgtggcgaaggggtggcctcggaggcaggctctggagctgcttggatgtctttaggtggggtggtggctggctctcttcagcatgtattggggaaaccctcgttctactaggggtgatacagatggtgattttaaagagcaaaactagacttctatgtgagaagtctagttttgctctcttcagcatgtaattggggaaaccctcgcgtctactaggggtgatacagatggtgattttaaagagcaaaactagacttctatgtgagaagtgctggaaaatgatttaggacatgtgtaaagttagatggaaagactgtaaatgtttaatatgaatatagtgttcttttgaagtaaggccagctgttgaacggttaaactgtgcatttctcattttgatgtgtcatgtatgttaatgtatgaaatgattaaataaaatcaaaactggtacctgtttatacataaatacgagaaaagacctatctttgcagccataaactcggtgggaacaccaccactcaagttgccaaaggaggcagtggtgaaacctgtcctgttctcacttaaatgaggatttagctcaaaataaagtggtggtgtcatcaggtttattccgtgttctgtcattcacatggaacaccggatgattagctaacagtttagtgccagccttcattctttactgtgtacgttaaatgcacactacagtgaaaaagcctaagacacttggtaaatattttctagctgactgattccagaacacacaa

SEQ ID NO: 68900 - DNA, 855 bp, Homo sapiens
cggggactgcggataaatggccttaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcgcctcagctgcctgggtccccgacgagagccaggtgacacttaactccgccatctgcgttttgagcactgttctcataatggagtttcctgatttggggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttga

SEQ ID NO: 68901 - DNA, 660 bp, Homo sapiens
cggggactgcggataaatggccttaggccgcgggcagcgagatgttgcgttccggtgtgggtgtgggtgtgcctccgacggcgtctcggtgccagtgtcgaggttctttctgcttagctacccggagccgactacggaggaggacacctgagtttacgtctcttccatctgctgctcgcctcagctgcctgggtccccgacgagagccaggatgttcacgtcccagtatgcccactctgtaatacccccatcccagtaaaaaagggccagataccagacgtggtggttggtgatcacattgacagagactgtgactctcaccctgggaagaagaaagagaagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttga

SEQ ID NO: 68902 - DNA, 470 bp, Homo sapiens
gccacatacaggtagagctccctctggaaagcagagtgctcagggagcctggggagggttgggggccgccgcatggaccaggcagctttgggtgggtctctgaggacaggtgacttgcacatggtggggacagtgggaagaagaaagagaagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttga

SEQ ID NO: 68903 - DNA, 452 bp, Homo sapiens
gaaagttcagttttcatcatgctagaggcttggaccagttattcattcttggaagcaatagtgcccagcagcggggccaggatgagggtgaagagagtaagtccaaggcctgtaagtgcacggctggattctgtcttgattgaaaattttgtcttttgctcatcatagattttttccccactaatcttcattatttatttacttttttagagacagagtctcactctggagtgcagtgttgtgatcacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttga

SEQ ID NO: 68904 - DNA, 708 bp, Homo sapiens
gttttagttacactcaatttaataaattgagggggcataaccaagtcctcaccattttaacaatttgtgctaacgcatttgaaaaaaattttacttccaacttctaaatccattatctctgttaacaggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagatttttacataccgttgctcaaaagagggctgcaagaagaaagagatgctgcagatggtatgtgcccaatgtcacggcaacttctgtatccagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttga

SEQ ID NO: 68905 - DNA, 615 bp, Homo sapiens
gttttagttacactcaatttaataaattgagggggcataaccaagtcctcaccattttaacaatttgtgctaacgcatttgaaaaaaattttacttccaacttctaaatccattatctctgttaacaggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaagcacagacaccctttggaccacagctgcagacacgggagtcgccccaccatcaaagctgggtgagaagagactccgctgcgatggctcggagcacgcagtagcatgcgtggaagcagcttacactctagtgggaagtggagccccattgagcaccatcccacactggctgctgatcttgtttgttgagggagatgggactataataaaattgaatgctgaagttga

SEQ ID NO: 68906 - DNA, 1639 bp, Homo sapiens
gttttagttacactcaatttaataaattgagggggcataaccaagtcctcaccattttaacaatttgtgctaacgcatttgaaaaaaattttacttccaacttctaaatccattatctctgttaacaggaagcattgttcagaaaagacttgcaagcagctagattttcttccagtaaaatgtgatgcatgtaaacaagatttctgtaaagatcattttccatacgctgcacataagtgtccgtttgcattccagaaggatgttcacgtcccagtatgcccactctgtaatacccccatcccagtaaaaaagggccagataccagacgtggtggttggtgatcacattgacagagactgtgactctcaccctgggaagaagaaagagaaggtaaggacagagcccgcctcagttccttcatctgggaagcctggtttttccttgggaagagtcagtttgctacctgaaaattactcccaatagtttatgtacaaagtagaaaagaagagtcctaacgctgcgttatccctgtcctaaactgcgaggggcctgagttttcagttttataaatgttctttaatatgagggatcccaggtcaggttcgtctttcttgactggaatttactagtttccctcctgagatggagaattcacatggctttctagatccattctgttcatgtgcgtttcatttgtttgtttgtttgtttgtttgttttgagacagtcttgctctgtcacccaggctggagtgccatggtgaatggtgccgtctcggctcattgcaacctctgcctcccgggttaaagcgattctcctgtctcagcctcccgagtagctgggactacaggcgcatgccaccacatccagctaacttttgtatttttagtagagacagggtttcactatgttggccgggctggtcttgaactcctcaccttatgatctgcccgcctcagcctcccaaagtgctgagattataggtgtgagccaccacgcccagctcaaggagcttctctagtgaactggctgctgtcaggcttaatccgttcctagtcatgggtcctggttggtggttaccaactatcttagtatatgatgttcaatactttacagttatattaccataaaccaaataacttttggtctcaaacatagagaataaaatcagtgttccttagtctgccacacaaaattctctgtgcggaagcttgctctggtccccactttctggccctgtctagctctccctgctgtggctgtgccctgggaccctcagcctctggaggtctcttaagcctctgagacatcacagctctctggcacacccgcttcttccacatgacacagcttcccttgctgggggctcacccagcactgccccaaggcccccacacaggaatgccctcccggctgctcctggcccgctgtgctcctgtccttttggtgggcacgccctgtgttctgcctgcatccctgcacgggtccctcctgcatggtcgctcagcatggccatgcctgcctgccttggccggagggccacccccggctgctggaaccctccccactctcctcactgccttcccctcttggagttctgactcctaggactttatatcgctgcctacatcctggcacc

SEQ ID NO: 68907 - DNA, 241 bp, Homo sapiens
tcttcaaacaagactccaggtaatttgataagatgtgcttacttatgcatggaattcaattgcatattgtgaaagagggacacatagaaaacagtgtctgtgaaaaatctaaattactttgaagcctactgaaaacttttatttatttgttttatttatttattttttggagacagagtcttgctctgttgcccaggcttaagtgcagtggtgcagtctcggctcactgcaacctctgcct

SEQ ID NO: 68908 - DNA, 470 bp, Homo sapiens
tcctgcacatataaacacatgtgcatcttgatttgcatctgtatcagatggtgtgtgttttaagaccttttctcaaatcttaaattttctttgttctggccttcaccttttgtgggtcatttcagcaacctctttgctctctttccttcctgcagtcttgtctgtgtgtcccccagcaccctttagactccttcccccacccccacctcctccctgtcctcttctcccatcttacctgcatcccccaatccactgtgttctgttgttctgttttgctgcagttttctacttgtcttctttaattgcatcagtctgtgtttagattcttttctctttaaactgcctctctcccagttgtctacttagtgagcttatcttgtgtttccagtacctagtgcaatgctggcatgtgcagcgtttaatacagatttgttagaagagtgaagtgaataaatgactggattaaaaaa

SEQ ID NO: 68909 - DNA, 245 bp, Homo sapiens
gcaaagtgttggcagcgtttattttttactgcttagaatttaaactttagatttagcaaacagtaggtaccaaacagtcttagatatatccagtagagaggggaaaaaagaatttattcttatataaaatttgaccctgttacatttagttcatcattttaatccatcaagatattttgtttactatacagattctgccatctaatatattttccacgctttcttgctctgtgtgactgcagcag

SEQ ID NO: 68910 - DNA, 414 bp, Homo sapiens
tcgacaaaaatattaagccaaaaaaaggacattaaaaagtcccaactcattggaaaagcatgacattttggtattgagtctttatgtccaagatgtcatgcttttccaatgagttgggactttttaatgtcctttttttggcttaatattttttctttagatcttatacatttcttaagttttgttcctataaattttatcctttttgttctgctacaacatgagctcttctaattgcttggttttctaggtatattaatgtcatctgtaaataattttttctttttccttccagttttcatactgctcactgcttttgctaattgctttgactaatgaatattagtaaatcaaagtgaagattttgggcttattttcttcatatatataaagggagtattgtaatgtttcatc

SEQ ID NO: 68911 - DNA, 507 bp, Homo sapiens
gacggggtttcaccgtgttagccaggatggtctcaatctcctaacctcgtgatccgcccgcttcggcctcccaaagtgtttttatttgatcttatcacagtagtcagcatattttgccttgtattatacttatatgtgtacatgtagtcttcccccagactagccattacttgagagcaaaattttagccttatccgtctaaatatcccccaagtgcttatctagtgaatgcctaattgtaatgcctattgacttaaatggaatttaattaaatggggtttgttatattctgctaagactgtagtagatgtagacacaagtctgattcttttcttataactaccattttcccctgttatggatatatcaaattacttaccacccttaacatctcctccagattaatttgtcttgtgtaagcccctagttgaccaaagctgatggctgattaaattcccccaagggaactcagccacacagccacataggttttttttcttttttggt

SEQ ID NO: 68912 - DNA, 570 bp, Homo sapiens
aaaacctggaaagtttgaggtagtagtgatagtccatatatggctaaaaaggatgttttcctcaagttgtaaaatgtggaatttagaaagtaaattaatatatttcaaaggattagttgaggtttaacatattttatggctatgaaggcaataaagacattttacacattgacgctgtgatgtagctacatcagagagtgtgacgtgcctgtggttgagccctccttattggctaagctggccactgtttttgaaacttaatggtaggcctctgacgaaaggtctaatgtggataaaacctgcattttataccagtgtaaatcaataatttcaactttgttatggtggttttgatgttttttctctgaaaaggaactcaggaaatgtgattaataaggtcaactgctagatttaattttgtttttgatggaaatattttttcctagaaaatttaatggccatgaatctgattgcagagattatttaccataactagacctgtcccctgacaggcaatttaaaccacttccattaaaatctagataatcagaaagaatgttgtggaacatt

SEQ ID NO: 68913 - DNA, 378 bp, Homo sapiens
attaatagtcttttaaaaaaattatgtgtttgaaagtaatttgtgtggttattactatttccgaaaaatcgaagtatcccattttccacattgcccaatgtactttaaaactaactgcaacctacttcctcaattcccaaatactcatatttggaaatgtaatacaaactgacgaattttagctctgctcatttaacttgacttctagtccacatttactcaataatttcagagcaaacctttattacccaaacccagactttttttctacctcgaatgcagttttaattattgaaggtctttccattacatttttattctaaaaaggactttggttaaaatataataccctataaataagatgtaagcattttattt

SEQ ID NO: 68914 - DNA, 474 bp, Homo sapiens
caagggcaccaggggggtttcctccccctcctcctctccctcctcctccccgtcctccttctcctcctcctcagcggtgactttccaggtggagcctttgaattttttaaaagaccatagtaatcagatctacttgaaaaattaagtgaattgatttggttggaatgctcttttaccgatgctttaacatacagccactagattcccagaagttgtgcatgagttcctgtgaggagagttggcatcttggaaatcaaagacggttgtgatgcagttttttgatatgaggataacaggaagcgtcaggacaatcatgcccataagaactctaaactgttcagatcattttatcttagtgaaactggcaattgaactttgctctagttgatgggcaaaatttctcctagactattcatcatcccaatttcatcctagttgaaaattttcaaatgccataagaaatctttatagatt

SEQ ID NO: 68915 - DNA, 346 bp, Homo sapiens
caagggcaccaggggggtttcctccccctcctcctctccctcctcctccccgtcctccttctcctcctcctcagcggtgactttccaggtggagcctttgaattttttaaaagaccatagtaatcagatctacttgaaaaattaagtgaattgatttggttggaatgctcttttaccgatgctttaacatacagccactagattcccagaagttgtgcatgagttcctgtgaggagagttggcatcttggaaatcaaagacggttgtgatgcagttttttgatatgaggataacaggctggagtgcagtgctgcaatcatagctcactgcagcctcgacctgctgg

SEQ ID NO: 68916 - DNA, 1731 bp, Homo sapiens
ggagcctcggttcccctcgggcggctgaaggaggggctgagcctcaggacccctaggccaggccgtgttgaaagcagataccccgaggcctcgcccagcctgcgctggagggaagaaggcgctggaggagcaccagcgaaagcagccagtctgagatattgacactacagaaaaaactgacagcttactccttgtattgattctactcttctctacaaatatagactccgttccctaccacagccttatagttctgccccagagacaagtatgaataccacagacaacggtgtcaactgtctgtgtgctatctgtggggacagagcaacaggaaaacactatggggcatccacctgtgatgggtgcaagggtttcttcagacgcagcattcgtaagagtcacatttattcttgcaggttcagtcggcaatgtgttgttgacaaggacaaaaggaatcaatgtagatattgtcgattaagaaagtgttttagagcgggaatgaaaaaagaagctgtacaaaatgaacgtgacagaataagcaccagaagaagcacatttgatggcagcaacatcccctccattaacacactggcacaagctgaagttcggtctcgccagatctcagtctcaagccctgggtcaagcactgacataaacgttaagaaaattgcaagtattggtgatgtctgtgaatctatgaaacagcagctcttagtcttggtggaatgggctaaatatattcctgccttctgtgaattaccattggatgatcaggtggcactgttgagagctcacgcaggggagcacttactgcttggagctacaaagagatccatgatgtataaagatattttgcttttgggaaacaactatgttattcaccgcaacagctgtgaagttgagattagccgtgtggccaatcgtgttctagatgagctggttagaccatttcaagaaatccagattgatgacaatgagtatgcttgtttaaaggcaattgtattttttgatccagatgcaaaagggctaagcgatccagtaaaaattaagaacatgaggttccaagtgcagatcggtttggaggactacatcaatgatcggcagtatgactcccgggggaggtttggagagttgcttctgctcctgcccacactgcagagcatcacgtggcaaatgattgagcaaatacagtttgttaaactttttgggatggttaaaattgacaatctacttcaggaaatgctattaggtggggcttccaatgatggcagtcatctccatcatccaatgcatccacatttgtctcaagacccattaactggacaaactatacttttaggtcccatgtcaacactggttcatgcagaccagatctcaactcctgaaaccccactcccttccccaccacaaggctctgggcaagaacagtacaaaatagctgcaaaccaagcatcagtcatttcacaccagcatctctccaaacaaaagcaattgtgaaaatgtgtttacttcagaacggcactacataaatgtgaaaagttgttgatcttgaaatatctcaagatagcacttttggcaaactcttagccaaggcttcttcattggtgctgttataagatggtatcctattttcttgtttatacgttcattctatttgttattgctactatgtgaaactttcacatgcaaccaatgtatatctgagtttgaaggatgtttatatagggtagg

SEQ ID NO: 68917 - DNA, 2071 bp, Homo sapiens
ccggaatctccactatgcgggcatgaggcggcggcagtcaccgcctggctgccccgcgggggcccgggagagccgctgcggtctcgggaggcctccgcctggctgccccgcggaggcccgggagagccgctgcggtctcgggaggccgggctttgggacttgctggcccgaccgccagtcgccctggggccttgggaacagggaaatgcgcgcgccgaggcggtggcggcctcgctgctttcagttttcattgagtctgctggttactgtttaacgtccccacccacgtttcagtttgtttagtaaatcgataggactgtgagagtcaggccgctgccctgtcgccattgagcaaagctaatattctcccagcatatggtctaaaatctttgctagagatcgggaaaaagaaacaaacaaacaaacaaacaacaacaaaatccttaagcttcctctcccaagtccccccatccccacccccacttcccacctcctcgctttcagcaaacttcccagcctgggaaaagtgcggcgcgggacagcgcgacggggtgggtgggggacctgctgccgggagatgcggcggcggccgcgcggctgactgcgactcgggagctccgggagcggcccgcgcaggagcaccagcgaaagcagccagtctgagatattgacactacagaaaaaactgacagcttactccttgtattgattctactcttctctacaaatatagactccgttccctaccacagccttgttcagtcggcaatgtgttgttgacaaggacaaaaggaatcaatgtagatattgtcgattaagaaagtgttttagagcgggaatgaaaaaagaagctgtacaaaatgaacgtgacagaataagcaccagaagaagcacatttgatggcagcaacatcccctccattaacacactggcacaagctgaagttcggtctcgccagatctcagtctcaagccctgggtcaagcactgacataaacgttaagaaaattgcaagtattggtgatgtctgtgaatctatgaaacagcagctcttagtcttggtggaatgggctaaatatattcctgccttctgtgaattaccattggatgatcaggtggcactgttgagagctcacgcaggggagcacttactgcttggagctacaaagagatccatgatgtataaagatattttgcttttgggaaacaactatgttattcaccgcaacagctgtgaagttgagattagccgtgtggccaatcgtgttctagatgagctggttagaccatttcaagaaatccagattgatgacaatgagtatgcttgtttaaaggcaattgtattttttgatccagatgcaaaagggctaagcgatccagtaaaaattaagaacatgaggttccaagtgcagatcggtttggaggactacatcaatgatcggcagtatgactcccgggggaggtttggagagttgcttctgctcctgcccacactgcagagcatcacgtggcaaatgattgagcaaatacagtttgttaaactttttgggatggttaaaattgacaatctacttcaggaaatgctattaggtggggcttccaatgatggcagtcatctccatcatccaatgcatccacatttgtctcaagacccattaactggacaaactatacttttaggtcccatgtcaacactggttcatgcagaccagatctcaactcctgaaaccccactcccttccccaccacaaggctctgggcaagaacagtacaaaatagctgcaaaccaagcatcagtcatttcacaccagcatctctccaaacaaaagcaattgtgaaaatgtgtttacttcagaacggcactacataaatgtgaaaagttgttgatcttgaaatatctcaagatagcacttttggcaaactcttagccaaggcttcttcattggtgctgttataagatggtatcctattttcttgtttatacgttcattctatttgttattgctactatgtgaaactttcacatgcaaccaatgtatatctgagtttgaaggatgtttatatagggtagg

SEQ ID NO: 68918 - DNA, 1055 bp, Homo sapiens
ccggaatctccactatgcgggcatgaggcggcggcagtcaccgcctggctgccccgcgggggcccgggagagccgctgcggtctcgggaggcctccgcctggctgccccgcggaggcccgggagagccgctgcggtctcgggaggccgggctttgggacttgctggcccgaccgccagtcgccctggggccttgggaacagggaaatgcgcgcgccgaggcggtggcggcctcgctgctttcagttttcattgagtctgctggttactgtttaacgtccccacccacgtttcagtttgtttagtaaatcgataggactgtgagagtcaggccgctgccctgtcgccattgagcaaagctaatattctcccagcatatggtctaaaatctttgctagagatcgggaaaaagaaacaaacaaacaaacaaacaacaacaaaatccttaagcttcctctcccaagtccccccatccccacccccacttcccacctcctcgctttcagcaaacttcccagcctgggaaaagtgcggcgcgggacagcgcgacggggtgggtgggggacctgctgccgggagatgcggcggcggccgcgcggctgactgcgactcgggagctccgggagcggcccgcgcagtgattgctgccttgaccgtccctgctcttgaagagcaccagcgaaagcagccagtctgagatattgacactacagaaaaaactgacagcttactccttgtattgattctactcttctctacaaatatagactccgttccctaccacagccttgcctcagaattcactgtgctgaggagctaacaggatcctgacatttaattgtctctgcctgagcattctgtcaactttggaacttgtatgagcacagacggggtttcaccgttttagacaggagggtcccgatctccagacgtcgtgatcctcccgccttggcctcccaaagtgctgggattacaggcatgagccaccccacctggcccaacaagcattcttttcacaacatgtttagtgccctgtttgcctcatttttgtgcttat

SEQ ID NO: 68919 - DNA, 388 bp, Homo sapiens
cttttgggctattggtctttcaacatgcagttaggggataaaagtaaatcatttaatctatgcagcatgtcactcaatagtatacttttggaaattgtttccacaggagcaccagcgaaagcagccagtctgagatattgacactacagaaaaaactgacagcttactccttgtattgattctactcttctctacaaatatagactccgttccctaccacagccttgtaagtggtgcccgctgaggctgctaaattgctttgtaaattatttattacttggacaccttgtaaagacctcttttcttcttgtctgacttgcttgtgctttcgtatatactaaaaggtctcaaagtgtacactgaccacaacctccttatgaaatccttt

SEQ ID NO: 68920 - DNA, 2278 bp, Homo sapiens
ccggaatctccactatgcgggcatgaggcggcggcagtcaccgcctggctgccccgcgggggcccgggagagccgctgcggtctcgggaggcctccgcctggctgccccgcggaggcccgggagagccgctgcggtctcgggaggccgggctttgggacttgctggcccgaccgccagtcgccctggggccttgggaacagggaaatgcgcgcgccgaggcggtggcggcctcgctgctttcagttttcattgagtctgctggttactgtttaacgtccccacccacgtttcagtttgtttagtaaatcgataggactgtgagagtcaggccgctgccctgtcgccattgagcaaagctaatattctcccagcatatggtctaaaatctttgctagagatcgggaaaaagaaacaaacaaacaaacaaacaacaacaaaatccttaagcttcctctcccaagtccccccatccccacccccacttcccacctcctcgctttcagcaaacttcccagcctgggaaaagtgcggcgcgggacagcgcgacggggtgggtgggggacctgctgccgggagatgcggcggcggccgcgcggctgactgcgactcgggagctccgggagcggcccgcgcaggagcaccagcgaaagcagccagtctgagatattgacactacagaaaaaactgacagcttactccttgtattgattctactcttctctacaaatatagactccgttccctaccacagccttgcctcagaattcactgtgctgaggagctaacaggatcctgacatttaattgtctctgcctgagcattctgtcaactttggaacttgtatgagatagttctgccccagagacaagtatgaataccacagacaacggtgtcaactgtctgtgtgctatctgtggggacagagcaacaggaaaacactatggggcatccacctgtgatgggtgcaagggtttcttcagacgcagcattcgtaagagtcacatttattcttgcaggttcagtcggcaatgtgttgttgacaaggacaaaaggaatcaatgtagatattgtcgattaagaaagtgttttagagcgggaatgaaaaaagaagctgtacaaaatgaacgtgacagaataagcaccagaagaagcacatttgatggcagcaacatcccctccattaacacactggcacaagctgaagttcggtctcgccagatctcagtctcaagccctgggtcaagcactgacataaacgttaagttggtggaatgggctaaatatattcctgccttctgtgaattaccattggatgatcaggtggcactgttgagagctcacgcaggggagcacttactgcttggagctacaaagagatccatgatgtataaagatattttgcttttgggaaacaactatgttattcaccgcaacagctgtgaagttgagattagccgtgtggccaatcgtgttctagatgagctggttagaccatttcaagaaatccagattgatgacaatgagtatgcttgtttaaaggcaattgtattttttgatccagatgcaaaagggctaagcgatccagtaaaaattaagaacatgaggttccaagtgcagatcggtttggaggactacatcaatgatcggcagtatgactcccgggggaggtttggagagttgcttctgctcctgcccacactgcagagcatcacgtggcaaatgattgagcaaatacagtttgttaaactttttgggatggttaaaattgacaatctacttcaggaaatgctattaggtggggcttccaatgatggcagtcatctccatcatccaatgcatccacatttgtctcaagacccattaactggacaaactatacttttaggtcccatgtcaacactggttcatgcagaccagatctcaactcctgaaaccccactcccttccccaccacaaggctctgggcaagaacagtacaaaatagctgcaaaccaagcatcagtcatttcacaccagcatctctccaaacaaaagcaattgtgaaaatgtgtttacttcagaacggcactacataaatgtgaaaagttgttgatcttgaaatatctcaagatagcacttttggcaaactcttagccaaggcttcttcattggtgctgttataagatggtatcctattttcttgtttatacgttcattctatttgttattgctactatgtgaaactttcacatgcaaccaatgtatatctgagtttgaaggatgtttatatagggtagg

SEQ ID NO: 68921 - DNA, 190 bp, Homo sapiens
taggtccaaagcagggcagggaaggttctccaaatgctgccccagctgtacaaactgtccctcaacccatccaatttccatgctcacctagcaacactcatatttttctaaaataatttttattacaaaacagtacatgcttataaaataaaaaataaaaaatgcataaagtagaaaaaaggaataaaaa

SEQ ID NO: 68922 - DNA, 377 bp, Homo sapiens
gttaatttcccttggaaaagtattgatgatcaagtgatgctagcagcaacagtgttaaaggctttaacgcttttaaagggtgacacaggcttaaactgagacaatccagcatggaacacttgcaggaagtactaggaaagtgcattttctttccatgagggttgccaaactggaagcatgttagctaaagctacctgtagtcattttgtggccacattgggtgagattgtctgagaaagcaaaccaactgaagcagagcagagaagatactctaccaacctagttggagccctggttccagccttgcctgaagctaaatgcacctctatgcttcctttttactgacccaataaatttccctatttgtttaaacaagc

SEQ ID NO: 68923 - DNA, 751 bp, Homo sapiens
gctgatttatttgcttatggtctgtttttatgctgcaacaagcagagttgaataatggtgacagaaatgatatgacccacaaagtctgaaatattcaccatctgtcttttataggaaatttgttgactcttgttctaaagtataacttgagtatagtcataacatgtttaatgctataaatcttgtattacttttttaattcctaatttttaactgtctgatagctaacaatacttataataatgctgaggtatacttttaccttccatattatcatcggatgattattttaaacacataattgtattcactctcacaataatcagcattattattatcagtcttattagcagaagtttgttttagttaggtgcttcccctgcccaacctaacctactcctcatatctctaaattttaaactaaggacattttaaattttaaattaatttccattctttaatttataagcctgttttcagattttctgaattggcaatgtttataaagtctggttgtattatcagtcaaggaaagataccacgttttaaaaatatctaattttttttagcttaggacatagtttctaatcatgtgcttgttttaacctctagctcttctctatatggggaggctgaggcaggaggattgcttgaacctgggaggcagaggttgcagtgatccaagattgtgccactgcgctccagcctgggcgacagagtgagacttgagactttgtctcaaaaaaaaaaa

SEQ ID NO: 68924 - DNA, 347 bp, Homo sapiens
ccctattctgagcacaaaagaaaccaggcatttactgtattgaactgtttacttctttttgttatattcaattttcccttggtaatcaggtataaaatccttaaaacaaaaagcctgtgtctttggaggcaggaaggagaaacagaagctggagagagcatgattgtaaaagagaagcgcctccagaacaaatctaacaaaaagaaggaataggagtgttactgggctttcctcaaaagagggcctgacagtggctcacgcctgtaatcccagctatttggtaggcagaggcgggaggatcacttgagcccagcctgggtaacatggcaaaaccccatctccacaaa

SEQ ID NO: 68925 - DNA, 359 bp, Homo sapiens
taccttccccctggtaactagtagaatactgacatatagtgcatatttattaaaataatgaataaaaaatgaattaaagagcagttaaagttcccagatgcttcactgtggacatgctgatgtttcgttatagttcttattctcagggagcattatcctcagcccctgacattcttccactttcaagtttttgagtagtaatttggaagatagatttggggaaagatcctgagatctgtacctacttatccaactatcaactcgacatgaccactttcatgcctaataggtttcgcagttttaatgtcttacctcttcctttctcattcttcacattagtcaatggccgtgcctcccac

SEQ ID NO: 68926 - DNA, 844 bp, Homo sapiens
ccatttgtatgtattcctgtgtattctcctgatggttaaatcgtggaagactatcctatggtggttaacatagctgatgttcttgccgtttattaacacaaatgatataaaactttaagtgttatatacttttttaaataatgggataagcctgtgtgtaggactgcattggtttgggcaggaatgaacagttctgggctgataatgaatggagttagagcagataggttcttagaggaagggcatgttggaagctccaatgcccatcttgcctccagtacctctacccatctgctgcttctaaagtggccacaggagacatagcagcttgtgacttaaatgtagcttgctgttcctagtaggaacttgagggattcagagagtaacgattttctgtatgaaaattatgtatcgtctctgagaatgcatagtgtcagatggaatagcagtgagcattccagttacatggcttaggattttaaaggtaaaatgctgttttagtgcgtattcagaattttgtatttttttcgaatttaaagtgtatccttctttacatgatttaatgttttatattccgatatcactaagtgaatattgttgattcactaatagtatgaggaatttcaatgaacatgatgatataaaagttgtaaaggcaatgataagactattgctgtgttaaaatatgactgtttatggttgctttcacatctcatttaattgtgtttttgcagcaccaattgtattatattacttaaggtcaagtaatccagttgactttatggcactttttcatttaacagtgccattcagtataataaatttctacagtgatttgaacatt

SEQ ID NO: 68927 - DNA, 509 bp, Homo sapiens
ttgggattcaagtctaatacgtaaaggttatgagtgagcacagagcaacccatttaaagggcttggtttcttttcaaaaaaaaataaaggcaaaacaagggtttgaagggcaaatttcgagaacttttcgttaacataacaagaactaagccactgagtgtattctgtgtcatattcatcacaactacagggactagcagtaaggaagccattaaattcccatctccagccttagcctagtattttatacacggttggttatgaaagcagaactcagaatgttaatttttttcacctatgtaatttatcttaagagtggcaataccaaaaggctactattgccctaagcaaacttcaacagttagccattttaaataaatactactgaattaagtaaaaatcgctctccagggaaaccccaagggtctcattctcagcccaatgcagatgggtaaattatccaagaacgactgctctgagaacgagaaaggctactcctttccagatgt

SEQ ID NO: 68928 - DNA, 288 bp, Homo sapiens
ataaattgttgctgcaacttttaatcaattgctcctgaagtctttattaaaatttatgtttcttagaactacctatatttaaaatgtttttgtccatcatctcaggttccacatttgaaagattttctcacatttacactttcatattgtgacttggcttaagaggtaaagttagagatatttcagaaatttgggtttataaattccttaacttgctttctatttcccatgattttagaacagtgtttctcaaactttatggtgactgagaatcccctagaaacttgt

SEQ ID NO: 68929 - DNA, 1021 bp, Homo sapiens
gttcctgctgttctttacagtatgggaacaactaagccatgcactggttatctggtctaaatatttaaaatagggaactactcagtggtacccaccattggttatactgctacctgagtcacatcatgagaatcacagcattttgtgcttggagaaaggcaaaagccatcttttttaatatcaggccatctattcctaatggatttaatcattatagggattgagagtggagaaagatggggtgagtgtgggtggagctgtacatttttatttttacctctcacaccccactggaccccaggtagctgcaaggtggggacttggattaagttttggcctgggcgagctgtggccttgggcaggctttccaggaggcctggcttagtttggtcactcacctgacagaacagcaagtgtgatggcagagaatgttccttctacaactggcctggcttcctgtgataatcctgtagaggttatttttgtataacatcagctttgacaaggagcaaaagcacagtgaaaacaaaccttatccaaaggagcagcataaataccctctgtcagtttgttcaagagcaagcgaactgcccctctgctctgttctttagcaggtgcatacacttgccagtgaaaagtccatggtttagctaatgcaggtgttggtgtcatcttacacatttgccttgctaattgctcatatttggctgcattttcctgcagttgttgcaagactttagtgcacaagattcaggctcctgagggtccttgttgtaccctaagcaccaaaattgctagttacagatctaggactgttttttcctagaatcaaagcagagaatagcgttctgtgcctctgtcctgcctcctactcccttgtcttttttgtacacagacctaagggtgtgagtgaaagctccattcctgacttgtggattggagaacagtgcccagttgtaaagtaatggcagaaatgtggaatctgatgaatgcaataaatcattaaatgctggaaatgaag

SEQ ID NO: 68930 - DNA, 2152 bp, Homo sapiens
  misc_feature (1289)..(1289): n is a, c, g, or t
  misc_feature (1292)..(1292): n is a, c, g, or t
cagctgggggagccacccatgggaatacagtcacatagtctctttccactcccccattccctgtgctatttaagttctaaaatgctattgtgggtttcttctgtgctagactcatatttatttatgctcctagctaggaaagaaatgtgtcctcagagtctacaggaggaaacttctcgtctctggagaatttttgaccatgagttggctttgtaactctaccctcagagggccttttaaacagctggtggttcttaaagaaatgaaatgcatgatgtgttactgctttgagctccgctgtggcagagcctggagctgagctcttggtgactggtcactgcacaattccatgaaagttcagataatataattgggtggtaaatgacacactaaatgaatctcttgggtgcagttgtttgcatcctaaactccagaatatgcagaaagagatattctgtgatagatatatctgccagttgggtaagcaaacaaaagtagatttgtcttcggcatgtgcaccaatggcaaactgcattcctacctagctttgaaataaattattggaagttctctggtgccttaaggtggtgtagaaggaaaagatccctggggtttgttaatgtatttagtcctcttctctgtgttatgggaatttctaaaaacagataatttgtacgttggacctaaaactgctttcaagaactcagtagacttgggattgaaggattgggttttctctttcccatgtgaacttccctaaatcctactctggcttcagaaagcacagctcctatacaagtctgacttctgcatttttagtgtaaatgtaatgtattgagtaatggaaagactaatggaagaattgatagctcaaaaatgagttttttccaacaccatttttttttgtctctgaaaacaccagcaggctgtgtccaagcatgggctgatgatccctttatgtgatgatagaacaagggaggagagagacaaattaatgggattgttaaaaatggctgaaaacttgatactaactttgagtcagtattttctttttaaagtcgtgtaatacaatatttgtagataggacattgaaagtgatgggggaaataaatgtctatgcagtgacgttatagccattaattctttagtggaaaaggacaaggtctgtacctaacagcagtaggagagtgagttttggggccagacacgcgacggctctgctgccgactaactgtgcaagcttggacagggtacctacctctcttaacctcaaagtcctccatggaaanagngggtaaggtgtgaagattaaagaaatagcacgcttcttaaagcactcagcatgtcagtggatgttgggagccttccctcacccctttgaaaatgggctctgcacaaacacattttggtgggaggctggggtctatcctaccaacctgagttgggggaataagatgatctcttccacagttcgggtttgcacaaccagcttttgcaggtgaggcagggaagaggcatgagtgtcattggcagagtgataagcgaggctggcaagttcactttggtagaacctctgtggactccttagttcttccaggttgaatcctgggcagaaatcacatgaaagctgtgaagcacagacatcagtttagaaattgtgtactttcccgctgaatcccaaatgcacaataactgtacaccttgcggttgcatgaatctacaaggtctcctatgcgccctcattcataaactcaaggctgagaatgttggcaggccaagtcctgcccctccccggagtgagctgccttggttcacacgggagtggtccagcgacaggacccgacacctcccctccggaagctcttcagcaggacctgcctcgggtcctggggcagctatcctccggggcctgcctgcagtgaaaccatcagtccgtggagatgttcactggattcctgaccagttgtgggtcgggctcaaccctccctctgggttttcaggatttgtaatgatcgctccatttgtgtaaaataggccggcattttctcttgttactgagatgtatttttctatgtgagttaaatgtataatttgtgtaattttgtacattaaaatgtatgctttttcacaattaaagggtttttttcccttc

SEQ ID NO: 68931 - DNA, 2250 bp, Homo sapiens
gctcataatctaggataatcacctatattaaagtcagttcactggcaaacttaattcaatctggtggcttaattcctctttgccatggaacatatattcacagatgccagggatctaagacatggccatatttcgggaaccattattcagagtaccagagttcaccctctggccctcaaaagattcacatccatcccaaatgcaaaacagatcaccctatccccacatcccctaaagacctaggatatggcagtatcaagtcaaaatcctaaatcttaacaacttaaacaccccaaatctcatcatctaaactaacccattcaaattaggtaaaaaggaggctccatgtttaatccaccctggaatacattgctctctatgaacctgtgaaaattaagaaacaagttatctgctccctaaattcactggtgaaacaggcatagaataacagttatagacattcctatttaaaaagggagagaagccaggcgtgatgtttcactcctgtaatcccagcactttgggaggccgaggcaggcggaccacgagttcaggagattgagatcatcctggctaacatggtgaaaccccatctctactaaaaatacaaaaaaattagccgggcgtggtggtgggcgcctatagtcccagctacttgggaggctgaggcaggagaatggcgtgaacccgggagggggagcttgcagttagccgagatcccgccactgcactccagcctgggcgacagagtgagactgtctcaaaaaaaaaaaaaaggagagagagagagaaatagacggaaaaaagaagtcatcagtccccagcaacttcaaaatccagcagggaccaggcatgatggctcactcatgcctgtaatcccagcactttgggaggccgaggcaggcagatcacttgaggtcaggagttcaagaccagcctggccaacgtggtgaaatctcatctactaaaaatacaaaagattagctgggtgtggtggcacactcctgtaatcccagctactctggaggctgaggcaggagaatcacttgaacccaggaggcagaggttgcactgagccgagattgcaccactgcactccagcctgggcagtggagtgagactctgtctaaaaaaaaaaaagggaaagaaaaatccagccagggatgctccatttggcttcaaggcctggaaatagacccaagtggctcatgtctggtttcttgccaccaaggtcagcctgctctttgctgctggacaatgcagtcccctccagcccctggaatagctcagcaatttcacagcatttttatataagtggtgatgtccgtttgagccccaaaatgtagctagtaagatccttaaggccagagtccaaattttcacttcaaatctgaagaaccagtgtccagaggggcagaacaactcttgttggtgggggtaggagagggaaggcacccagggagtggagggactggtgagaccagagcccaagcctcccgatccgagtaccccagtctttccattttatcttccaacagtacttgacaaaccaaacttgagaagtagccccgtttcatgcggacttaaggaaacaatggagctgcgtggtattgtgaggagcagcatgatgtggagaaggaaacaaggacctggggactcagacccaggttgcagtcttggctctgacacttcctggctatgtgatgtgactttggacacgtttcttaacctctctgagccttgggttattgctcgttaaagatgagatttacaagatctgtttttatacctctttgctcatggcagtctgtgagccttgacttgcttctttaaatggggttcacggactaacaacatttgtatccctggggagcttggtagaaatatagacctaggagaacccctgccccaccccaacctacagaatcagaatcttcctttgggtaggatccccaggtgatctacatgcacaataaggtttgagaaatacccccactctttgctcattaaacctgcagactctgttcaggtgtgcttcccccaagccacactcctccggggcttggctcggagcatgctgggtgcagacatcggtaacctcttagcttaatgtaccaaaattgcatgcataaagatctgtatcaagactgtcagattctcaggggcagaagccagtcttatcctctgcaaatcctgcatgtctgcctggcactgaatagttcccggcaattttgaaccaattaatcatca

SEQ ID NO: 68932 - DNA, 309 bp, Homo sapiens
atggtttcaccatgttggccagactggtcttgaactcctgacctcaagtgatccacccacctcccaccttggcttcccaaagtgctaggattacaggtgtgagataccgtgctcggccctgaatattctctttcttgatgacagcaataattaacatctattgagagcttaatacacatcaggcactcttctaagcagagaggcaatatggcctgctggacaactgcccaggcactagggccagattgccagtgtttgaatcctggttctgccacttattagctgtgtgaccctgggcatattcttttt

SEQ ID NO: 68933 - DNA, 232 bp, Homo sapiens
aatccagtactgaggggctgttagtgaagaagggatgaaggactatctgtgggatcagggctgccttgaaaagataaagaaatggtcagcactgcactccagcgtgggcaacagagaaagaccctgtctacaatacagtacaatacaatacagtacaatacaaaacacacagaaatgatcaggagtgaacctacacttgtgatgtgtaggtatgagaagtggaacaattagg

SEQ ID NO: 68934 - DNA, 850 bp, Homo sapiens
tttgaaccttaatttaaattcttttcttttccatttagagatatgtttttttctttaccttcatacctttctatttcttgctaatttctatcactaattccttataattgtccctgctccccttcttgatctcttcagggggaatactaggcagttttgtatcttctgatctcgtaccctgagacttcatctgaatgtgctctgccgccttcttatctgaactagatgaattggccataattatgaataggaatattaatgaaccagaggacatactagtcacatgttattatacactaaaaaataggaagtcatcttgaaaggcagttaatgtactgcaaatgtccctatgacttctttgctttctcttataccaaacatgcaggtatttaatttgtttaatgagggttgagtggagttatgtgtcgcttttattcggattgacgaaaatcaaccataattttcaagggatcttcatgggttgtgactggaagctgaccttagtcttgcgtctcatcctttatgatgttgagaaatcatctaatttctcagaactttttcttatctctaacacagttattaccataataatattgtctccatttatcatacaggatcattatgaaagtaaaatgaagtagtatatatgaaaatgctttttaaacacaaaagctttatacaaaatattgttgaatttaaataaggtaaatcttttttagtttatatatttgcagactatacatgttggattaaatgggcaattaagttttataggaatttgcttcctaagtctacttttgaagaggaaaacaggaacgtaccatatattttgctaagggtaaaatatttt

SEQ ID NO: 68935 - DNA, 1496 bp, Homo sapiens
  misc_feature (1438)..(1438): n is a, c, g, or t
ttcaaagctctgcgcagaagtgtccctgaagccagacgtcttctaactggttggcctcccctccagggcagcagacactatgtgcgcgccagctgcgggatccagcggccccttctcagcctccctgtcactctcccagctgcccggagtgtgccagtccgaccaaagcaccactctcggggcttcacacccaccttgcttcaaccgctccacctacgcacagggtaccaccgtcgcgcccagcgcagcccccgccacccggcctgcgggagaccagcagagtgtctccaaggcccctaacgtgggctctcgcacgatagctgcatggccgcacagcgatgcacgggaggggactgccccctccacgaccaactctgtagcaggtcacagcaactccagcgttttccccagggctgccagcaccaccaggacccagcaccgaggagaacatgcccccgagcttgtccttgagcctgatatctcagctgcctccaccccactggccagcaagctcctgggccccttccctacctcgtgggaccgcagcataagctcgcctcagcccggccagaggacacacgccacaccccaagcccccaacccgagtctttccgagggcgagattccagtcttgctgctggacgactacagtgaggaggaggaagggaggaaggaggaggtgggaacgcctcaccaggacgtcccctgtgattaccatccctgcaagcacctgcagaccccgtgcgcggagctgcagaggcggtggcggtgccggtgccccggcctcagcggggaagacaccatcccagacccgcccaggctgcagggggtgacggagaccacggacacgtcggcgctggtccactggtgtgcccccaactcggtagtgcatgggtaccagatccgctactctgcggagggctgggcggggaaccagtcggtggtgggggtcatctacgccacggcccggcagcaccctctgtacgggctgtcgccgggcaccacctaccgcgtgtgcgtgctggcggccaacagggcgggcttgagccagccacggtcttcgggctggaggagcccgtgcgccgccttcaccaccaagcccagcttcgcgctcctgctctctgggctgtgcgccgccagcggcctgttgctcgccagcaccgtggtgctgtccgcatgtctctgcaggcggggcagacgctgggcctgcagcgctgcgacacgcacctggtggcctacaaaaaacccggctttgatgattacccgctgggggctccagaccgtcagttagcccagcttctgggataacgcgtctcatcgaactggatctgagcgcaaaaggaagacacagacggtcaaaaacgaccccatccgctcctagggtttctaattcccgtgaagccagaatgccttgagcacacatggaacttgccactgntgttgggccagacgttgcccctctttatattgtccccaaattgggtgcggttccctgg

SEQ ID NO: 68936 - DNA, 1766 bp, Homo sapiens
ttcaaagctctgcgcagaagtgtccctgaagccagacgtcttctaactggttggcctcccctccagggcagcagacactatgtgcgcgccagctgcgggatccagcggccccttctcagcctccctgtcactctcccagctgcccggagtgtgccagtccgaccaaagcaccactctcggggcttcacacccaccttgcttcaaccgctccacctacgcacagggtaccaccgtcgcgcccagcgcagcccccgccacccggcctgcgggagaccagcagagtgtctccaaggcccctaacgtgggctctcgcacgatagctgcatggccgcacagcgatgcacgggaggggactgccccctccacgaccaactctgtagcaggtcacagcaactccagcgttttccccagggctgccagcaccaccaggacccagcaccgaggagaacatgcccccgagcttgtccttgagcctgatatctcagctgcctccaccccactggccagcaagctcctgggccccttccctacctcgtgggaccgcagcataagctcgcctcagcccggccagaggacacacgccacaccccaagcccccaacccgagtctttccgagggcgagattccagtcttgctgctggacgactacagtgaggaggaggaagggaggaaggaggaggtgggaacgcctcaccaggacgtcccctgtgattaccatccctgcaagcacctgcagaccccgtgcgcggagctgcagaggcggtggcggtgccggtgccccggcctcagcggggaagacaccatcccagacccgcccaggctgcagggggtgacggagaccacggacacgtcggcgctggtccactggtgtgcccccaactcggtagtgcatgggtaccagatccgctactctgcggagggctgggcggggaaccagtcggtggtgggggtcatctacgccacggcccggcagcaccctctgtacgggctgtcgccgggcaccacctaccgcgtgtgcgtgctggcggccaacagggcgggcttgagccagccacggtcttcgggctggaggagcccgtgcgccgccttcaccaccaagcccagcttcgcgctcctgctctctgggctgtgcgccgccagcggcctgttgctcgccagcaccgtggtgctgtccgcatgtctctgcaggcggggcagacgctgggcctgcagcgctgcgacacgcacctggtggcctacaaaaaacccggctttgatgattacccgctgggggctccagaccgtcagttagcccagcttctgggataacgcgtctcatcgaactggatctgagcgcaaaaggaagacacagacggtcaaaaacgaccccatccgctcctagggtttctaattcccgtgaagccagaatgccttgagcacacatggaacttgccacactgagtgtctgggtccaaggaactgctgccctcccttccttctacttaactctgttcccagaaacctgatggtcaatgccagatcgctccccactgccgccaggccttcttgtgtgttgttggttcatttgcggttttcagcagtcagtgcctctctatccagtagaatagtgtatggacgtaggaagggatgaaacagagaagttgcataacccagcctctttgatcatgttagaaatcacatcctcaggtctttccagcggaagctccttcatggtcaagctctaagacacaacgagctctgttattcaagaaatcaattccagtgga

SEQ ID NO: 68937 - DNA, 787 bp, Homo sapiens
  misc_feature (12)..(12): n is a, c, g, or t
tctagctcgcgnatcctgaggaggcggggttggcctaggcgaagatccggactctgggtgttttgctaccgtgaccgtttagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaatattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaagaggtgaaagccaaagaaaactggccacttactttggactgggtgagaaaacctggaaaacatttggaattagcttaggaatggagggccttctaatacaagggaaagggggctccattttcctgagttcttctgccctggacttgtgaggt

SEQ ID NO: 68938 - DNA, 1135 bp, Homo sapiens
  misc_feature (12)..(12): n is a, c, g, or t
tctagctcgcgnatcctgaggaggcggggttggcctaggcgaagatccggactctgggtgttttgctaccgtgaccgtttagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaagagacgcattcaattgggcgagattaaatcagctga

SEQ ID NO: 68939 - DNA, 1180 bp, Homo sapiens
gtcttgtctgtgttccctgttgtgattggcttggagtaggatacctgtctacctcatattacttatatttttccctgtcttcattttatctccctctggttgcatacttcatcactgaacacttaagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaagagacgcattcaattgggcgagattaaatcagctga

SEQ ID NO: 68940 - DNA, 1243 bp, Homo sapiens
gtttctattaaaaaattagttttaaattttaaattacaataaaataaagtgtaagtattaaaaggccacttgtctatttctcacttggaatattaaatgctggaagctgtgtttgcctgtttatgaagatagaaacctaaatgcccttttgttctgtttatatgtttgaatgctcaatgttcatttccagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaagagacgcattcaattgggcgagattaaatcagctga

SEQ ID NO: 68941 - DNA, 958 bp, Homo sapiens
  misc_feature (12)..(12): n is a, c, g, or t
tctagctcgcgnatcctgaggaggcggggttggcctaggcgaagatccggactctgggtgttttgctaccgtgaccgtttagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaagagacgcattcaattgggcgagattaaatcagctga

SEQ ID NO: 68942 - DNA, 981 bp, Homo sapiens
  misc_feature (12)..(12): n is a, c, g, or t
tctagctcgcgnatcctgaggaggcggggttggcctaggcgaagatccggactctgggtgttttgctaccgtgaccgtttttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaagagacgcattcaattgggcgagattaaatcagctga

SEQ ID NO: 68943 - DNA, 804 bp, Homo sapiens
  misc_feature (12)..(12): n is a, c, g, or t
tctagctcgcgnatcctgaggaggcggggttggcctaggcgaagatccggactctgggtgttttgctaccgtgaccgtttagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaaggtaattgaggtgaaagccaaaagaagaactggaccacttaactttgtgacttgtatgagagagaccctggcaatatcggaatcccatatgaatgggggggtcttttcttatttgcggg

SEQ ID NO: 68944 - DNA, 1030 bp, Homo sapiens
gtcttgtctgtgttccctgttgtgattggcttggagtaggatacctgtctacctcatattacttatatttttccctgtcttcattttatctccctctggttgcatacttcatcactgaacacttaagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgagtttatgccagttattcagacagaaagtgaacacaagcctcctgtaaatggaagttactttgcccatgtgaaccctgcagatggagggtgcctactggagaaatacagtgagaaatgtcatgattttcagtgtgcattactggctaatctttttgccagtgaaggccaacctggcaagcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaagagacgcattcaattgggcgagattaaatcagctga

SEQ ID NO: 68945 - DNA, 1066 bp, Homo sapiens
gtttctattaaaaaattagttttaaattttaaattacaataaaataaagtgtaagtattaaaaggccacttgtctatttctcacttggaatattaaatgctggaagctgtgtttgcctgtttatgaagatagaaacctaaatgcccttttgttctgtttatatgtttgaatgctcaatgttcatttccagaacagaaactgttcatacttggtgcgctgtggactcttgtgataattaaccaagagtagctctatttgtccaacctcacacctaaagaagaaagaaaatggcttgtgctgagttttcttttcatgtaccaagtcttgaagagcttgctggagttatgcagaaggggttaaaagataactttgctgatgtccaggtctctgtagttgattgccctgatttgactaaggaaccctttacctttcctgtaaaaggcatctgtgggaaaactagaattgcagaagttggaggtgtgccttacttattgcctcttgtaaaccaaaaaaaagtttatgatctgaataaaattgcaaaagaaatcaagctgcctggagcctttattcttggagcaggagcaggtccatttcagactctcgggttcaattctgaggtaattgaggtgaaagccaaaagaagaactggaccacttaactttgtgacttgtatgagagagaccctggaaaaacattatggaaataagcctataggaatgggaggtactttcataattcagaagggaaaagtgaagtctcacattatgcctgcagaattttcttcctgccccttgaactctgatgaagaagtgaataaatggttgcatttttatgaaatgaaagctcctttggtttgtctaccagtttttgtctccagagacccagggtttgatttgcgactggagcacactcatttttttagtcgtcatggagaaggtggacactaccattatgacactactccagatatagtggaatatcttggatacttcttacctgcagagtttctctatcgcattgatcaaccaaagagacgcattcaattgggcgagattaaatcagctga

SEQ ID NO: 68946 - DNA, 376 bp, Homo sapiens
gtttataagtaaaactactttttgtttttctttttgatactcatatacttctggatttgggagacatttttggtggggttagttagacaaactatttattccataaaggattccttgaagaatttccctgaaggtggtcatttagtttccttttaagtgctacttgtaaaggctggccaacccctttcagggcagctgttttaccaatgtgaaaatgctactagaatttgtactagaaaattctgccattaagtgtgtcactaaatgaccttgtaaggtaacataaagtgccttctcctagatgaaagaaagctttctgagtagctgaagatacttcttactcttagcagtgttaacaaaatgcttctaggttttt

SEQ ID NO: 68947 - DNA, 454 bp, Homo sapiens
tggtcttgaactcctgacctcagattatccgcctgcctcagcctcctaaagtgctgggattacgggcatgagccaccgcgcctggcaggaccctgtctcttaaaaaaggaagaagcagcctgtgtcgcaggcacaagtatgcccgcagggcagtggtaacccccagtgggcctgcctgtggggggtctctggacaggataagccacatggctcatagtgattgttttcggggcactcaatagctgcaggggcaggagtggggatggagaaagacaggaagggaaaggtattcacaccaggactcccaggtctggtttccaagacccaagcatttggccacccctatagtgcaaatgtccctgctctcagcttccaggaatccctaccaacatcctgtggtcctcaccctctagaatggagctctccaggcaacagacccagcaatccctgcctc

SEQ ID NO: 68948 - DNA, 348 bp, Homo sapiens
cgaggaaaactctgtctcaaaaaataataataaaaataaataaaaattttaaaaagtaatgggtctggctgggcatgctggctcacgcctgtaatcccagcactttgggaggccaaggtgggcggatcacctgagatcgggagttcgagaccagcctggccaacatggtgaaaccccttctctacaaaaaatacaaagttagccaggtgtggtggcacgcgcctgtaatctcagttacttgggaggctgagggaggagaagtgcttgaacccagaggcggaggttacagtaagcggagatcgtgccactgcactccagcctgggcaacagagccagactgtgtctcaa

SEQ ID NO: 68949 - DNA, 213 bp, Homo sapiens
cccccccccccccccccccagcaaggaaaagagccttggaaagttgtgaggaaaggaagaagacaatatccaggtgagggctagttgggcaggaagaagccatcaacacagggaaccccagatcactggggaagagacacatccttatgttgtttagaaagccctcttgaaaggtctgtggcccaaggaggaaaggtctgtggcccaaggagg

SEQ ID NO: 68950 - DNA, 494 bp, Homo sapiens
cgggttcgcgccccgagtgagcagtcctggcccggagcgtcggtcctggtaatctgtaggaaaagcgctgcggcccagggggtaaagagagatcagcctctgtggactcggtgcttctcctggcaagtaaaccccaaggaggactgaccagttcttgaatttctataccatggcccttcgatcagtgatgttcagtgatgtatccatagacttctctccagaagagtgggaatacctggacttggaacaaaaggacttgtacagagatgtcatgttggagaactacagcaacttggtctcactggcaggatgcttcatttctaaaccagatgtgatttcctcattggagcaaggaaaagagccttggaaagttgtgaggaaaggaagaagacaatatccagatttggagaccaagtatgagaccaagaagttatctttagaaaatgacatttatgaaataaatttatcccagtggaagataatggaaagaattg

SEQ ID NO: 68951 - DNA, 438 bp, Homo sapiens
ctggtcttcagagcttgagggccaagggagcaggaagccttcacaggaaaagaaaggtctgagtgaaagtgactgaagagaggtgggaaagggaagggagaggcctctggtcttgttgtgcaaggagagggagtgtccaggtatgtagatggggtgtgagcctcttttagagaagtaagggttgggctcacttgcaagcactcaggaaggaccggaaggaagaaagtgaagatgccgtccccattgtgtccctcagcgcccagagggtgtgtcgacctgctcctcaggccaggccagcccaacacctgtgactaacatgacctcagagtctaaaataatgtgtgccacagctctgaagtcagaaggctgatttttataaatcagcacaaattgaccttattacccatggtccttcagtgacctcagaaatcaaagtga

SEQ ID NO: 68952 - DNA, 651 bp, Homo sapiens
agaatgaagtccctcaagaaactgacagtgtattaatgcgttcccaatacagatactccttgaggtacaatggggctttgtcctgataaacccattgtaagttgaaaatatcataagttgaaatgcattcaagacacccagcttactgaggcctcacagcttagcctagcctacctaaaacgtgctcaaaatatgtgcattagcctacagctaggcaaaatcatcaaacactaggccaattttataataaagtgttgaatgtccatgtaatttattgaatattgtactgaaagcataaaaacagaatggtttatggatactcgaagtacggtttctactgaatgggaatcacctttgaccatcttgaagttgcaaaatcctaaactgaaccattgtaagtcaggcaccatctgtaaatgtctcatatttcctactgggaataaagtttaaaatgaaataactgattttctgaaactggcactcaatttaagtcaaaaatagtttaacagtaaggcttgcattgctaggacttacagctttagtgggcagaagtatcatcaggggagcgtgttaaaatgcatattctcctgagacgagattgcgccattgcactccagcctgggtaacaagagggaaactttgtttcaaaaa

SEQ ID NO: 68953 - DNA, 376 bp, Homo sapiens
tattgtatgattccatttatttttttccctttttaaatttttcttggtttttatgctaatcttctctgtactcttccaattttagtatatgtgttgcaagcatgtattattccagttatatgggatgttcagaaaaggcatttggagacaacatggattagtggttgccttgggctgggggtgggaagaaggattaactgtaaatgggcatgagggatcttaatgtgcgacagaaattttcaaaaaacggattgttgtgatgactgcaaaacttggcaaatttactaaaaataactgcattgtacatcttaaattagtgaattttatgacatgcaaactatgtctcgatcaagttgtctttaaaaactaaaggcaa

SEQ ID NO: 68954 - DNA, 398 bp, Homo sapiens
actattcctggcacatgataagacctcatttttgttgtgattgtacttatattatcacagccctctagtagaactcccagcctccagcatcttccatttttaatagttacatacaaaacaggattttttttccttttaaaaactaaattgataaaaattgtatatatttatcatatacaacatgatgggtttttttgtttggttttggtttggggggggcagttattttttgaaacaggatctcgctctgttgccaggctggagtgcagtggcatgatctcagctcactgcatcctcgacctcccaggctcaaataatattcctgcctcagcctcctgagcagctaggactataggcacgcaccaccatacctggctactataagatttttttgcaga

SEQ ID NO: 68955 - DNA, 358 bp, Homo sapiens
acatgttccttgcagctttgccacttcattcttgggcccacgctgaagaaccagtctttttctgaaacattgctaagaatgtggcagaaggaagagatatggcagaacttcatcatggccctgacaaactctgctctgaaaaccttcatgatggtgctgaaaactgactccccctgagagttccttggctaaatgagtcacttggccaagcctgacatcctcagagtgggaaaacaatcttcccaaaataagggcaccataaattacatagccaaacctcatgtcagtagaatggcaggtaaaatcctcccacaagaaggagcagcatatatttggaaataaaaaatgcagtccacta

SEQ ID NO: 68956 - DNA, 998 bp, Homo sapiens
tttgataaataaaggaatcattgcacaatttgcatgtgtgaattgcagaagtacgcgcatgtaggtacatacctctgccgaggagcagtgttttaatttctaagccactctgtctactgtagtggagaaggaccagactaacttgcatttctccagctgtataacagataacctgtggaaacacagttaattgacatcattgctcttctgtgtgatcccagtgaggatttagctctctatatgggctggcaattgttcagccatttcatcttttaatctggctttggttgttctgagaggaaaaaaaaaacaaaaaacttttttctctttactctcacacactcagtacagcccttcacctcttgtcaccaaaatgtatgggaatttcttcccaccgacaaccaattctccagtggccaccaactctacgtcctataatttaacccagttctgacactgtgtacctggagttagtgtcagatcccatacgttcagggctcagtcccaaaagactgccccccacttcaaatgccaatcacaagtcccaggttgtgactatatgttgtttatgattaaccaaccagttacaaatctggattcccacaagcccctcctccggtttgattaatttgctagagtgactcacggaattcaaggaaacactttacttatgtttgcccatttattataaaggatattacaaaggacagatgaatagccagatagaagagaggcccagagaaaggtatgtgggcaagggtgtggaacttccatgccttctcagcccctccacatgttcagctatcccaaagatccctgaatcttgtcctttgggattttaatggaggattcattcataggcacaattgatgacatcattggccattggtgatcactcaacttgagcccttctctcttccccagaggtcagaggatggagctgaaagttccagctgcataatcacatggttggtttccctggtaaccagcccccatcc

SEQ ID NO: 68957 - DNA, 289 bp, Homo sapiens
tttgtttactctcctgtttcggtgaactttatcttccattgtcattttgagaaataatacaaagatgggaagaaagttgagatcttatcagaagatatactttgacttcttatcttttgatatggtttgaatataggcttctaggtgaaatatcactttacctccaaatgttgaatacattgctccattatcttctaggtttagatccatactgttgagtagaaatataatgtaaggcacagatgggagctcatctataattttaaatttcctagcatccacgttaaga

SEQ ID NO: 68958 - DNA, 479 bp, Homo sapiens
actcagtggagatttatttgcaatagtaggatcaggtgatttgaaatctttagtgtgtgtggttgtagcaggaggagtactgggttccagcatttaataagaggacccatggttttatgaaaatgtccagagatataattttggttaaggttatacctcatctttggttgtacagttgtttcttttagtttcagtacaatctaaaacaggaaatgtcaattcacatggtctggtagagaaagaatgactctaatgctctactattcaggtagaaatgaagaaagaagggtgatcacttccatgagcactgtaagcccttgaatgggcttataggcaaatacttatagttaaaatatgtaactcccattttagtattggatagaatactgtcacattttttcttattaaatctacatttttaccatctttcttgattgattttgccaataaaagttccttacctttttataaaagtcaaa

SEQ ID NO: 68959 - DNA, 496 bp, Homo sapiens
  misc_feature (7)..(7): n is a, c, g, or t
cgccccntgggatcaagcgattctcctacctcagcctcccaaatagctgggactacaaggtgccctccagcatgcctggctgatttttgtatttttagttgaggtgaggtttcaccatgttggccaggcgggtttcgaaatcctgacctcaaatgatccacccacctcagcctcccaaagtgctgggattacaggcatgagccaccacaaccgtcccactattttactttttaaaatgacattcctactgattgatttttatcttgctataagttcgatgacaccgtgaatctaataaggttcactgttgacacagtacaagttacatagctaaaatacatagcattgaagactaattttaaggattgacaagagtttattttctattgtgcaatatcttaaaggaagcacccacctttgggaaagtgtatctgctgctcctagggccatgcttgtatacatatttaaataaacatattcatttacccgaataata

SEQ ID NO: 68960 - DNA, 414 bp, Homo sapiens
gccattaaaaaagaagaatagatttgcattcagcaaaaagctaataaacgtagttgataccctttaagttatgacttgcttctgaaggttaagataacacatgagattacaggcatgagccaccacaaccgtcccactattttactttttaaaatgacattcctactgattgatttttatcttgctataagttcgatgacaccgtgaatctaataaggttcactgttgacacagtacaagttacatagctaaaatacatagcattgaagactaattttaaggattgacaagagtttattttctattgtgcaatatcttaaaggaagcacccacctttgggaaagtgtatctgctgctcctagggccatgcttgtatacatatttaaataaacatattcatttacccgaataata

SEQ ID NO: 68961 - DNA, 469 bp, Homo sapiens
ctcaaattgccatcaacagtaagttgaaggcaatttcaacttactgtttctaatttgaagagggaacattaagaatgcctctgtaatactgtaattatgggaagaaagcaccagaggcaacattttatcctgagcaccagatttagatcctgttaaagggctcaaacttaaaagggctggccgggtgcggtggctcacgcctgtaatcccagcactttgggaggtcaaggtgggaggattgcttgagccagaagttcgagaccagcctgagcaacatggtgaaaccctgtctctaccaaaaatacaaaaattagccgggcgtggtggtgcacacctatggtcctagttactcggaagactgaggcaggaggatcgtttgagctcaggaggttgggtctgcagtgagctatctatgatggcaccactgcacttcagcctgggtgacagagtgagaccctttctcaaaaat

SEQ ID NO: 68962 - DNA, 567 bp, Homo sapiens
gaaccaccagcactgccaggcccttgctagggagctggaccaggcattaggaccagggtttcctctgccctgcagggtttttggatcccacactgggggagacagagcatgatctttggggatttgagtcccagctctgccactcactagctgggtggccttggggagtagtcacttgcctttatctcacaggacagagtgagtcaagcatacaggatggtgtctggcacacgcagtaggtcaatccacatgtgtcaccttcaaaatctgggcattaggccgggcgtggtggctcacacctgtaattccagctctttgggaggccgaggtgggcgaatcatgaggtcaggagttcaagaccgcctggcgaatgtggcaaaaccccatctctactaaaaatacaaaaaattagctgggcgtagtggcaggtgcctgtaatcccagctactcgggaggctgaggcaggagaatcgcttgaacccaggaggcggagcttgcagcgagctgagagtgcaccactgccctccagcctgggcgagagcgagaatccgtctcaaaaaaaaaaaa

SEQ ID NO: 68963 - DNA, 595 bp, Homo sapiens
agccgagatcgcaccactgcactccagcctgggcaacagagtgagactctgtctcaaataaataaataaataataatttcttgaaggtgtaccagactttctcttcactttattgcctcctaaaagaatattaatttaaaattccttatgttaaaagtaatgtattctgcaccgtcttgtcccatttttctatttattttaaaatgtgtagctttttagcaaaagtaatacatcaacatggttaaaaaatatgaatattccagaaaaatatttattatatctaatagtgggtgtgtttccccactctgggttcatttctcaaccgtctatacaaacttgatcatattttatctacttttgtaccttgatcttttctcttaattagatctttactttccccaaagagtatgagtgaaatgtattgacagacccctccatatttgattggcatatgaggcatgctgccttagtgaaaaaatagctgagtctgggtgcagtggctcatgcctggtaatcctagcactttgggaggccaaggcaggcggatcatttgagcctaggacttgaagaccagcctgagccacaaagcgagatt

SEQ ID NO: 68964 - DNA, 592 bp, Homo sapiens
agtagagatggggtttcaccatcttggccaggctggtcttgaactcctgacctcatgatccacccacctcagcctcccaaagtgctgagattacaggcgtgagccaccgcgccaggcctggtctcttttgaataaacaaattgaccctcccagtctaaaaacttgagaaatttacatttgtcttatctgagttcctttctcagggaactagccatcagtcctcccagatagcaccaaggaactgaaacttatcggatcaccacatctggaaaatcagacaccagacccctcacctgcaacaattgcctgatgcctgttgacccactcctcttcatctctccctaactcctgctattttcccacatgcagttacatttcttccctgctatatcctaattttaatcagttgagaagatggatttgagactgatctctcccccctaggctgtagcacccaaataatgccttcttccctgacaataatggggtctcagtgactggctttctgtgctgtgaaccaccagacctagaccaaactcctggcatttctctaacaatttcccaccactgaactaagttataaattctgagg

SEQ ID NO: 68965 - DNA, 313 bp, Homo sapiens
gacaagtgctatattttattttaaagaaaatcaaagggatttaggatattggcagaaatgcaagtatttcttcagtgtctaagatgtgttgccacttgatggatttaagttaacacttagggcttcttaggaacattatcagccactaaagccctttggttagggctcagtcatctcttcagttagtcttagagatgtggttcattgaataagactttagcatattttccaaccaagttatttttggttgtcttgtttttgcaagagtgaaacttgattaaaacattacaacaagaatattaagtagttttaa

SEQ ID NO: 68966 - DNA, 881 bp, Homo sapiens
gagaaagaagcctttccgccttcctactctgtaaccctgcttttcgtttcctgtgtgtcctttcagagctccttttgctttcaaaagcaaatacaaatacgggcagcttctgaatggatggccaagtgactctggagcttccgcgctgtgtgagggctgggctttctgtccctgttcaccctcgaacccaggcttcagccaccgcacgggagaagatggttcagaccacacctctaccctgactcagcacacacagctgtaccgtcaggggctgcaaaccaacatctctcagggccttcctggaagctgcggctggactccccttgtactccaggggagcatccctggaggcccaggtcggggctcctggagggtccctgggttctgggggacagaagaacagggaggaagaatccagatgtggctcactgggctctgtggatctggcactggaacagctgtccaggctttggggcccccgacacccctgctgctctccctccggccccagatctgcttgggcccccagtgggcaaccgctcagtgctggcccaccacagggaaatattccggtggaggtaagctctgtcctgttctcagagagccctgaccaggcctggtagataaattccaggccaagccataggatttggacactggggctacaggaattcaagaaagaagaataaagaagcagccttgagtattagtcagtgaatgtggcctgacattggcagatggctttagcacagccttcctggaggaaaaggaggagggagactgcactgaacgggtttctgaaacttgtgccctgacgccaagcataccaccacatcacttataggatgtgcaagtataaacaagggattttgccgctctgc

SEQ ID NO: 68967 - DNA, 898 bp, Homo sapiens
gagaaagaagcctttccgccttcctactctgtaaccctgcttttcgtttcctgtgtgtcctttcagagctccttttgctttcaaaagcaaatacaaatacgggcagcttctgaatggatggccaagtgactctggagcttccgcgctgtgtgagggctgggctttctgtccctgttcaccctcgaacccaggcttcagccaccgcacgggagaagatggttcagaccacacctctaccctgactcagcacacacagctgtaccgtcaggggctgcaaaccaacatctctcagggccttcctggaagctgcggctggactccccttgtactccaggggagcatccctggaggcccaggtcggggctcctggagggtccctgggttctgggggacagaagaacagggaggaagaatccagatgtggctcactgggctctgtggatctggcactggaacagctgtccaggctttggggcccccgacacccctgctgctctccctccggccccagatctgcttgggcccccagtgggcaaccgctcagtgctggcccaccacagggaaatattccggtggaggtaagctctgtcctgttctcagagagccctgaccaggcctggtagataaattccaggccaagccataggatttggacactggggctacaggaattcaagaaagaagaataaagaagcagccttgagtattagtcagtgaatgtggcctgacattggcagatggctttagcacagccttcctggaggaaaaggaggagggagactgcactgaacgggtttctgaagatggtggcgggaagcgaggcagaccgacacgatgaagtataggatggcgaagaatagaagtgggatggggtgagatatttccctcctttcccccc

SEQ ID NO: 68968 - DNA, 334 bp, Homo sapiens
actgcatcccctcaaaattatatgttgaaatcctaagctacggtacctcagaatgtgaacttatttggagataacatctttacagaggtagtcaaggtaaaatgaggtcattagggtggaccctaatccattgtgactagtatccttgtaaatacaggaaatttggacacagaaacatagtcagagaaagaagacgatgtgagaagacagagcagaaagatggtcatctagaagccaatgagagaggcctggagctagatccttctagttctgagacttctagcctcagaactatgatacaataaatgtctgtggttacagccacctagactaa

SEQ ID NO: 68969 - DNA, 1755 bp, Homo sapiens
ctattgcagtatctttcagcttccagtcttatctgaagaccccggcaccaaagtgaccaggaggcagagaagaacttcagaggagtctcgtcttgggctgcccgtgggtgagtgggagggtccgggactgcagaccggtggcgatggccactctcccagcagcagaaacctggatagacgggggtggaggcgtgggtgcagacgccgtgaacctgaccgcctcgctagctgccggggcggccacgggggcagttgagactgggtggctgcaactgctggaccaagctggcaacctctcctcctccccttccgcgctgggactgcctgtggcttcccccgcgccctcccagccctgggccaacctcaccaaccagttcgtgcagccgtcctggcgcatcgcgctctggtccctggcgtatggtgtggtggtggcagtggcagttttgggaaatctcatcgtcatctggatcatcctggcccacaagcgcatgaggactgtcaccaactacttccttgtgaacctggctttctccgacgcctccatggccgccttcaacacgttggtcaatttcatctacgcgcttcatagcgagtggtactttggcgccaactactgccgcttccagaacttctttcctatcacagctgtgttcgccagcatctactccatgacggccattgcggtggacaggtatatggctattattgatcccttgaaacccagactgtctgctacagcaaccaagattgtcattggaagtatttggattctagcatttctacttgccttccctcagtgtctttattccaaaaccaaagtcatgccaggccgtactctctgctttgtgcaatggccagaaggtcccaaacaacatttcacttaccatattatcgtcattatactggtgtactgtttcccattgctcatcatgggtattacatacaccattgttggaattactctctggggaggagaaatcccaggagatacctgtgacaagtatcatgagcagctaaaggccaaaagaaaggttgtcaaaatgatgattattgttgtcatgacatttgctatctgctggctgccctatcatatttacttcattctcactgcaatctatcaacaactaaatagatggaaatacatccagcaggtctacctggctagcttttggctggcaatgagctcaaccatgtacaatcccatcatctactgctgtctgaataaaagatttcgagctggcttcaagagagcatttcgctggtgtcctttcatcaaagtttccagctatgatgagctagagctcaagaccaccaggtttcatccaaaccggcaaagcagtatgtacaccgtgaccagaatggagtccatgacagtcgtgtttgaccccaacgatgcagacaccaccaggtccagtcggaagaaaagagcaacgccaagagacccaagtttcaatggctgctctcgcaggaattccaaatctgcctccgccacttcaagtttcataagctcaccctatacctctgtggatgaatattcttaattccatttcctgaggtaaaagattagtgtgagaccatcatggtgccagtctaggaccccattctcctatttatcagtcctgtcctatataccctctagaaacagaaagcaatttttaggcagctatggtcaaattgagaaaggtagtgtataaatgtgacaaagacactaataacatgttagcctccacccaaaataaaatgggctttaaattt

SEQ ID NO: 68970 - DNA, 2241 bp, Homo sapiens
tcaacattcaaaactgaccaaggaaccccactagctagacatgtgtagtgattaccagcaaacctcaggccaggctcactcaggactggctacccccaggaaggaggggtggcatgccagtaaggaacctggcctcagcagcaagttgtttttttctgcaagtatcgtgtatttcttctccaaccaattttgttccccttggttcctgggaaccattatatcgttaggttaatggaccattggtttatccacctgtatgttgcctgaattttggccattcaaccatgcattcctggtgattgggtttacaagtactagtttcctaagtccaacatcatgttcagatatctcgtgacgataaattggtgtagtaaccatggtatgtcagcaaagagatggccccactcattaaaaatatgttggtattggaggcttcaaaaacttgtatatttgttactgatatatagaacaaataaatggccaaatacaaaattgtgcagaacccagattatctagtatctaataaagaattaataaagaatatgtattaatgtagatgtctttatttacatattaatggcttttttcaaattggccaaatttttcaaaacaattacatattaaaaattgagatacatggaaattctaacaatagatttatagtcattcttggggtgggcattaacactttttggtaacttctgtaagttaattatagtttaacttcctaattaattaattctgtatgttaatttatagtttaacttcctagacgctttggtgtctttttttaccctcactttaaaatacacacaatagtttaaatatatcacatttggtcaaaagttcaaattattttattatttaaagcatgtagaaaaaatataatagttaaaattcctgtgaaaaattctaatacagaggaatcacatggctatgtttggaaagataatatttctttaaaaatgtgttgttttttatgttttatgtttgcgataagcattactgaagtttgattgaagaacttcatgatttttatgttttactttcttgtattgagaaatagtggtccattgttgggctgtatttaaaattaatgtgtataaaacaagaaatatttaattagagttattaattttccacatttaatatgtgtatttgacctaaatcagtatcttctatcatatcagcctcacatataacaagaataatcgcaaggacaacaacaaatttgaatgtttcctttgtgcctatgctcctatcatgttatattcattcttataaatctaacaactaacaattaatttgaagttagacacacaggatttactcatcagtattagagcattcactgctagccaagaaggttactatccctggtgctgaaactgctctgtgtagtccttgtggttgaagaattaaaacagtttctcttagacatttcctttcattgaaattatgaattggataaatgttcataccttaaaggaagtattaaatttcacatatgttaacatcttaattaatgtaagattaatattctacttatgactatgttttagtattgaaaaatgagtttctgatgagtttcattagtttctagagaaaacaatggtttaaaaaatttcagtacataagacattgaggagtctatgaatgttccagaaatctgaaaacatataccactaatcaaagtttctccattcatgttgactagcatttgccttaggtgtcagaattaatggatttgtgttaaaaataaacacctgaaatctaattccctagctgcattataacacactagattacaagtactaagcttttatttaatgcttataacggctttaaattgtagcaaaatgggcttcccccaagaggactgctttgttgatcctaagatggggtcataagccagaagttaactatgctttcatatattcttgtaagtagaagtacagtgttggtgtaaattctccttagatggataggtaagcccagaggaaataatggtcattggcaccatatgaccgtatgcaattcatatgcatatttatatcaagaaaagaacattataggtctggtgagaccctatttttttctgacagtgtcatctgtatttacgtgtctatttcgggaatttggaagtcaagggattctatgctggattgtgaagcatctgtttctgcttgatgtagctactcaattttgtattcttgactaataaagtcataaacataatgc

SEQ ID NO: 68971 - DNA, 737 bp, Homo sapiens
tggagatgaggcccagcagggggtgattttacactaaagcagtgattctcaatcttgttttaatgccagagaagccactctgtgcttttgtgaacatcttttcagctcaagtgactatattcaaacagattgcttgaggtcagtttgagaccgtcctggccaacatgatgaaagctagtctctactaaaaatacaaaaattagctgggcctggtggcatacccttgtagtctcagctactcgggaggctgaagcaggaaaattgcttgaacctgggaggcagatgttgcagtgagcagagatgccaccactgcagtccagcctgggcaacagacaagagactctgtaaactttactcatatatatatatatatatatatatatatatatatatatatatatatatatatatatatatatatgaaactatgtatcattgttaactatagtcatcctacagtgctatagaacactagaacatgtgcctcctatctagctgtaattttatatcctttaacaaatctctgcctgtccccctcttccccctaccctttccatcctctggtgtcctctgaggaaccctgtcttatacagcttcgtacccctcgaagcataatagtcacccgtggtactcaataagttacctgcctggatggtaaatagctacataaataaaacattgttttccaccatgaagtaataagaagccctttggcaagaagctactattagtacatc

SEQ ID NO: 68972 - DNA, 312 bp, Homo sapiens
aaaagatttgaacagataattcatccaaaaaaaatatgggtgggaaaaaaagcacatgaaaagatgctcaatatcattagacattaagaaatataaattaaaaccacaatgcaatatcacctcgtatctattagaatgtctaatattagcaagactggccatatagagtgttggtgaggatgtgaacaactgaaactcatacacagtgcaggtggaaatgtaaatgatacaatttttttggaaaagagttggctgtttcttcaaaagttaaacattacatctgccatatgatccagacattccactcctaag

SEQ ID NO: 68973 - DNA, 343 bp, Homo sapiens
tttattctctttcaatcccaggaaaatggttgcattcaaacttgatcaagtcatctttcttttttccatttcttttttctacacttgagagtcttgattcttctcatccttctccttgctctcattttccatgattaatcaactaccataataggtcattttaccttttaatccccaactctctgtcatcagctggtacacctgctcatttccatttgtttgggttagcatattacccaataactctttccctatttcttgatgtctctgtgttcaccatgcccactgcaaaaattctgcctgttatctcttctggctttgttctcctccactatcctttttt

SEQ ID NO: 68974 - DNA, 285 bp, Homo sapiens
ccaaaagtcatacaaaaatatttgtagcattcagctattatatttaagtctctcttgatgaccatcatttgcttttgataatttattaaatattctttagcattttgataacacattcaaaacccaccatacaataagtcctcacttaatgtcatcgataggttaacggaaactgtgacttttcagtgaaacaacacactatgtgccatagaaacttaattcttgtttatatcaactaacaaggtaaattgatttctttatagtgtatataatttcacttgaagt

SEQ ID NO: 68975 - DNA, 440 bp, Homo sapiens
agaaaaacccaactaactaacaaatcaccttaattactacctgcagagaaaaagggttggctttatgtttcttttttaattgtgtgtgtttttagctcaatccacaaatgagaaataagtgttggtggaaaaacagagaccagttttgcttatatatggtgtggtgggtggagagaaagggtacatcagattgctacctaacagagcgaggaaatcagttcttattttccattagaaaacaaaacaaatggcaattaatccattcatgtctgaggttgcaggtttttgaatttttgcaatcagaccttggcgatgaccttgagcagtaggatataaataactcccacatgcttagagttccaatgatggaacactaggcataaatgggctaaagacaaaaaaaaaaaaggtggtgattttttggacttcccagggagcac

SEQ ID NO: 68976 - DNA, 2197 bp, Homo sapiens
  misc_feature (771)..(771): n is a, c, g, or t
  misc_feature (925)..(925): n is a, c, g, or t
  misc_feature (927)..(927): n is a, c, g, or t
  misc_feature (1502)..(1502): n is a, c, g, or t
  misc_feature (1993)..(1993): n is a, c, g, or t
  misc_feature (2078)..(2078): n is a, c, g, or t
gcgacatatgccaatgtggccatctcgggtgatttaaaagatttgttaccctctgcgtgcacttatagcccaggtatgtcctgtctcccctggatggctgattggtgatttttaaaagggtttccattgtgctgtgggaacctgaaggcatcagaacgggcttttgcttgtttgctgtgtcatattctgttcatttaaagagtaaaagtgtgtggttggtattgtggcccatgttgagccaaagcaaagagtaagccactgtctgaagcccacctacgttgaatgtaatgaggctgagatgaaaaggatctgctacactgaacacagaacgtggaggtctgggctaaccacacaaaatatgctgtgtgcagtgaacattcacgctgtactcttagccacatcccgcacaaaagacagagagacagctcccaggagatggagcatgtgtggcaaagattttccgcctggttactttgaagaaagcaaaaggaggctgaaactgtgctttgtaagctgcatgggttggtgctggctcctggacgtcagttcagaacactcaggagtgaaggcagaaacctggtgagggactcccaggaggagcttctttctccacctttcagcctctggagttcaaatttcactcaacctgagtgcaccaaaccccaccctcttatttacattgccctggcctttttggcggaatcaaagtccctacatagccaaggagatcttttaccttctacactagtgggaggccaggtgcctgggagngaggtggcacgcccccgccctcctctggcatgccactgtcctgctgtgaaagcctgtgtcaaggaaaactgggctcagaggtgcagactgagagagccgctgggctgttttgaaggaaggtaagcagagagcatttgtgtgtgtgtgtgtgtgngngcgcgtgcatatgtgtatgtgtgtctgtgcctgtgtggtgagtgtgtgtgtgcatgtgtgtggcttctgtaatgctacaaagacctgaaactgagctgtgtgcctgctgagatttaccaacttgccaagacttccagaggaaaagagctggtactagccaggaggagagggcgttatggagtggaataatcagcagaacggatgctttaaccgggcaagaaggaatgtcgctcaggacttgtccaggaatgcctttattggtttgcaagctggaggagtcttaacttactgacttctttttggggaagagtcagtgatggtctgacatgctgtttgcaagctctctggccgcctctgtggccagccggcgtgggtggcctcagataaggccaacaggacctcctcttttcctctgggcttgggcccctgtgttttcagttaggagtgcccaaaagggaactgagctgcccagtcagaggcctgagataggcgcctgctgaatgctgagcctgcaccggcgtgctggtgtgagaggtctgcccggggagccgccctggcctgccctgctgtcagtncggctgtgggggcaccttggcggcgtctgtgacacgcctgccacagccccactcggagcacagtgctcctttatcgccacattccagagcctcacccaggagaccgcgggagcgcttggaatctggcccagctcctgagtcgctcctgctctgcagtgggatgccttcccttcccagagaggcagtgtgtggctgggcaggcgtttctgtgtggaaggttctgctctggttcttgcttttgttaattttttttctgctctatatttctctaagaatttacagtctgcctcatttttagaaagcgtgagcaagcagctcagctttacttcagagggagggattttccagcgccctccggcagtctcagcaaggtgtcctggtgctgccgctgcagcctctttcctgctgggcacctcccctcctggcagctcagagggtgatttgggtttgggggcttgggaaggagttaactctcaaggtgagactgatgnaccaagggagcaatgccttagaatggagttattctgcctaaggagagaaagagttgtccctacagagtagagtttattaccgtcntttattttttgtaaaaacaaaaataaaaaaagaggaaaagggcacatttcatcgcgtcttgaaatatatcaaaatcatagagtatctgatttagtagattaaaagcagtgttctcaaag

SEQ ID NO: 68977 - DNA, 425 bp, Homo sapiens
gatctcccaacttgaggatcctcagtagcctcctgagtaactcacgccggctaagttttttatattttgtcgagatagagtcttactttgttccctaggatggattcctttttctgcttcatctggtaccttaggccactaataatttcttctctctttctgtatttttagcttctccctcgctaccactaactcctttcttctctcatgttaaatttctttcatttaacacaaaatagtccccctagcttcttccctctaattactacctgttactaattactaatctaattattatctttccttccagaagccaggctcttggaagaatagtctattctgcaacctttctcagctctcattctcaccagcttttgcccccaccacatccttgaaactcatctttcaaaagacactaactgcta

SEQ ID NO: 68978 - DNA, 1157 bp, Homo sapiens
aacttttggtccagaggagggaggaggaagggaagaccccagtggtgggaccctggaccaggccatggatgaaggacaaagaccagggcaggtcacgggtttcccaattccccagcaattaagatttcgagcagaatttatctaaatgtgtttcaaggaaacacaatcgctgaaccaaaacgtactgcagccgagccccctccgtccatcctctgcccctccccctggcttctttctcttgggaaaacgggcaaaataattgtgctggattctcacacacacagaaatatcgaccatcaccctcccccgcgtgaactgggatgcaagttgctaaccgatgtgaacgcaaaatgccttgttcattattcctgacgagatcttgaggttgtttgatgctttaaattttttaattatattattttctaggtgtttattggtacattgcagttttttttttgaaatttaaaaatttctgtaaaactttgtcttcaagtaatctgacagcattaaatattgcatttaaaaattatactgtagcaaatacatttaaaaattaatcacaacgttaagatgaaattatatttttggaaaaaaaaaacacttgaagcccagatggaaatacgtttatttcagcagccttaggtttcccctcgctttctcaacacccttccttgtcctggagtatggactgtccgtccaaaagtgagcctatgctataagtttaatgagaaccgaattcagcctgcattcgagaatagctttaagtataatgctgatctgacaattgacgtgtaatttgggaagtcattttgataattttgcttaaaccactcattcgttaaagtgattacaaaaaagttcaagaatgatgtccactgctttctaacaagataataaaccccccccctcttttctttttctttatttttatttcttttagctatttgatcctttctgaagcagttgtttctggaagagtctgtgcgcccatggatggctgagcaccactacgacttagtccgggataagggcctccccagtcctctccgggagatgatttgggaaattttataatgcttgttctgttaactcaccgggaccttgagggtccaatgggaccttgagggttttctctgaaatatacaaacttaaaggac

SEQ ID NO: 68979 - DNA, 618 bp, Homo sapiens
cttggggtgtcatgttcctctggtttccagtctattgaccctgtcactcataacaacctcctctgcacctggggttcctctgcctcacagcctgggtacaggtcctgaagcccagaaaaaggcagtagccacattccctgcctggggacactgccaaagacggaaatgaggcttgcctgccatgaccggctcagccagacaaacctcatttcctttctggcatggtaagaagttccagttctaagaagaaaccagcccttaggaatgtctgaaatcccaccttcctgggaagaaacaagagggaaggagcctggatatgtggcagaaacttggtaaccttcagaatgtggtcaatgtgatcatcctcattccctcccctctccccccacccccacacagctggcctcagtcgagagcagcaaacatgtctcgcccagggaggcgccactcattcacccccaggggcagccgcctccttgggccccttggccctgcctccaaagaacagctgtaggccagtgatttggcacctgggccacgttctcccatggaaaagaggtggtatgtgggggatctggtgattactctcatgattaaggggctctgcttggctcagac

SEQ ID NO: 68980 - DNA, 228 bp, Homo sapiens
ttagcatgcaggcaaactgaagctcattaaagcccaagtcatttgcccaaggtcccagtgacctgccgagtgggaagagccgtggctggccggcctcccagtggcgacgacgacctcgctgtgttcgtggcagcggcactctcaaatctgggcacggtgatgggaaggttatttgttggaatccctttgcctttccaagggaaaataaacacaaaaagtgagaagtct

SEQ ID NO: 68981 - DNA, 285 bp, Homo sapiens
ccaaaggtcacgatgatgcaagagatgggttcccatgatcttgggcagctccactcctgtggctttgcagggtacaggcttcctcctggctgctttcacgggctggtggtcccagtgacctgccgagtgggaagagccgtggctggccggcctcccagtggcgacgacgacctcgctgtgttcgtggcagcggcactctcaaatctgggcacggtgatgggaaggttatttgttggaatccctttgcctttccaagggaaaataaacacaaaaagtgagaagtct

SEQ ID NO: 68982 - DNA, 242 bp, Homo sapiens
gacatgaatggtatcctcctggggtatgagatccgctactggaaagctggggacaaagaagcagctgcggaccgagtgaggacagcagggctggacaccagtgcccgagtcagcggcctgcatcccaacaccaagtaccatgtgaccgtgagggcctacaaccgggctggcactgggcctgccagcccttctgccaacgccacgaccatgaagccccctccgcggcgacctcctggcaacat

SEQ ID NO: 68983 - DNA, 380 bp, Homo sapiens
cttgagaaggtgacatctgggctatgccgggctgcccttctgttttggtagagtcactgccttcactgccccacccttgaaactggcttgcttttgtcacaaccaccggagaggcgttggtgtgagagtgagacccgtcactgtggacgtgttcacacgcatggcgctctggctgtcctctccttccctggagcccgtgcctttgttaagatctctaggacctgctggcatggcagcttgcccgtaaagcctctcagcagggagggctactgttcttgagggtgagagacagaagtggccgccctgtggtctgagcctgcccggcacagccactgactgcacttgtggtgactgtcagttagggctccgatggcttattc

SEQ ID NO: 68984 - DNA, 548 bp, Homo sapiens
cagcgaaggaggaagcaaggtcccctgcagacaaattccctgaaaaggccaaaagccctgtcaaggaggaggtcaagtccccagagaaggcgaaatctcccctgaaggaggatgccaaggcccctgagaaggagatcccaaaaaaggaagaggtgaagtccccctttccaggttctttacggctgtacttcaactctgggccccctgctgctctctaccccaagcttaggcgactccactctgagatccctcccccgtcaagaaaaaaacaagtttcctctacaggaaaaaagtggtgcaggattctggtctgcaagcgctggagactcttagcccttctaagtagcaaggcttccccgccaatgctgccatgctctctcctgcaccccgcaagaaactctattcctctcacccctaccaggctccttcccactacctgctcggtgcttaacgttcctaccttaaatcttccacgtgggggtgggtcaggaccttttcgcatcctttcttcctagagggaaccattactacagtcagttgttgcctgt

SEQ ID NO: 68985 - DNA, 241 bp, Homo sapiens
acttgaacccaggaggtggaggttgcagtgagcaagatcacgccactgcactccagcctgggtgacaaagcgagactctatctcaaaataaataaataaataaataataaaaaatgctgaaagaaaacagtcaacctagaattctatatcctgtaaaacagaggtccccagcccccaggccacagactggtctgggtccgtggcctgttaggagccaggccgcacacagcaggaggtgagt

SEQ ID NO: 68986 - DNA, 4252 bp, Homo sapiens
caggctggaagcggcgccatattggcgtcggccgcgctgtattgtcataaatagagccggttttgtggtgttttcactactcggttggatgcctcagccatagtaagtgggaaagtgagcgagcaagcgagctactagcgaccggaggaaagtgaacagggggagaagggaacagcaagaacaggactccagagcgataaacactcgctggagagggagacgcaggaagcgatgaaagagatgtctgcaaacaccgtgctggacagccagcgtcaacaaaagcattatggaattacctccccaattagtttggcatctcctaaagaaattgatcatatttacacacagaaattaattgacgccatgaaaccatttggagtgtttgaagatgaggaagaattgaaccacaggctggtggttcttggtaaattgaacaatttagtaaaagaatggatttctgatgtcagcgagagtaagaacctcccaccttctgttgtggctactgttggtggtaaaattttcacatttggatcctataggcttggagtacacaccaaaggagctgacattgatgcactttgtgtagctccaagacatgtggaaagatctgatttttttcagtctttttttgaaaaattgaaacatcaagatggcattagaaacttaagagctgtagaagatgcctttgtacctgttataaaatttgaatttgatggtattgaaattgatctagtctttgcaagactggcaatacaaaccatatcagataatttagatctaagagacgactctcgcctgagaagccttgatataaggtgtattcgcagcttaaatggttgtagagttactgatgaaattttgcatttagtgccaaataaagaaacttttagactcaccctaagagctgtcaaattatgggcaaaacgacgtggtatttattccaacatgctaggattccttggtggtgtctcctgggcaatgctagttgcaagaacttgccaattgtatccaaatgcagcagcatctactttagttcataagttctttttagttttttccaagtgggaatggccaaatcctgtgctgctgaagcaaccagaagaaagcaatttgaatttgcctgtctgggatcctcgggtaaatccatcagataggtatcatctcatgcccataatcacccctgcctacccacaacagaattctacgtataatgtgtccacatcaactcgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaagtttattcgacttgaatcaacatttaaggacccccgcactgctgaagaaagaaaaagaaaatcagtggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttgaagcttcct

SEQ ID NO: 68987 - DNA, 506 bp, Homo sapiens
gtggtgatctagaggatcctgatgatctgtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgactgactttctagctgggcctttataatatatatgatgtgcttttcctttttcgtttcctctttctttctaatagagactacccagtaaagaactaccagattcatcatctccagta

SEQ ID NO: 68988 - DNA, 4106 bp, Homo sapiens
caggctggaagcggcgccatattggcgtcggccgcgctgtattgtcataaatagagccggttttgtggtgttttcactactcggttggatgcctcagccataaaacaccgtgctggacagccagcgtcaacaaaagcattatggaattacctccccaattagtttggcatctcctaaagaaattgatcatatttacacacagaaattaattgacgccatgaaaccatttggagtgtttgaagatgaggaagaattgaaccacaggctggtggttcttggtaaattgaacaatttagtaaaagaatggatttctgatgtcagcgagagtaagaacctcccaccttctgttgtggctactgttggtggtaaaattttcacatttggatcctataggcttggagtacacaccaaaggagctgacattgatgcactttgtgtagctccaagacatgtggaaagatctgatttttttcagtctttttttgaaaaattgaaacatcaagatggcattagaaacttaagagctgtagaagatgcctttgtacctgttataaaatttgaatttgatggtattgaaattgatctagtctttgcaagactggcaatacaaaccatatcagataatttagatctaagagacgactctcgcctgagaagccttgatataaggtgtattcgcagcttaaatggttgtagagttactgatgaaattttgcatttagtgccaaataaagaaacttttagactcaccctaagagctgtcaaattatgggcaaaacgacgtggtatttattccaacatgctaggattccttggtggtgtctcctgggcaatgctagttgcaagaacttgccaattgtatccaaatgcagcagcatctactttagttcataagttctttttagttttttccaagtgggaatggccaaatcctgtgctgctgaagcaaccagaagaaagcaatttgaatttgcctgtctgggatcctcgggtaaatccatcagataggtatcatctcatgcccataatcacccctgcctacccacaacagaattctacgtataatgtgtccacatcaactcgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaagtttattcgacttgaatcaacatttaaggacccccgcactgctgaagaaagaaaaagaaaatcagtggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttgaagcttcct

SEQ ID NO: 68989 - DNA, 4152 bp, Homo sapiens
caggctggaagcggcgccatattggcgtcggccgcgctgtattgtcataaatagagccggttttgtggtgttttcactactcggttggatgcctcagccatagtaagtgggaaagtgagcgagcaagcgagctactagcgaccggaggaaagtgaacagggggagaagggaacagcaagaacaggactccagagcgataaacactcgctggagagggagacgcaggaagcgatgaaagagatgtctgcaaattaattgacgccatgaaaccatttggagtgtttgaagatgaggaagaattgaaccacaggctggtggttcttggtaaattgaacaatttagtaaaagaatggatttctgatgtcagcgagagtaagaacctcccaccttctgttgtggctactgttggtggtaaaattttcacatttggatcctataggcttggagtacacaccaaaggagctgacattgatgcactttgtgtagctccaagacatgtggaaagatctgatttttttcagtctttttttgaaaaattgaaacatcaagatggcattagaaacttaagagctgtagaagatgcctttgtacctgttataaaatttgaatttgatggtattgaaattgatctagtctttgcaagactggcaatacaaaccatatcagataatttagatctaagagacgactctcgcctgagaagccttgatataaggtgtattcgcagcttaaatggttgtagagttactgatgaaattttgcatttagtgccaaataaagaaacttttagactcaccctaagagctgtcaaattatgggcaaaacgacgtggtatttattccaacatgctaggattccttggtggtgtctcctgggcaatgctagttgcaagaacttgccaattgtatccaaatgcagcagcatctactttagttcataagttctttttagttttttccaagtgggaatggccaaatcctgtgctgctgaagcaaccagaagaaagcaatttgaatttgcctgtctgggatcctcgggtaaatccatcagataggtatcatctcatgcccataatcacccctgcctacccacaacagaattctacgtataatgtgtccacatcaactcgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaagtttattcgacttgaatcaacatttaaggacccccgcactgctgaagaaagaaaaagaaaatcagtggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttgaagcttcct

SEQ ID NO: 68990 - DNA, 2909 bp, Homo sapiens
aggaggtggaggttgtggtgagctgagattgcgccattgcactccagcctgggcagcaagagtgaaactccatctcaaaaaaagaaaaactagtggattcatgaataggattgtgatgtgatggaagtgtattaaaaatatttgttttgtgagagggttgtgggtgggtgggtggccggtggtgatagtggggagatagtaaaagtatatgcatttcagaaaaattaggcagaacccttggttcagaaagaagtttcccatttaacatattaacattgttacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaagtttattcgacttgaatcaacatttaaggacccccgcactgctgaagaaagaaaaagaaaatcagtggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttgaagcttcct

SEQ ID NO: 68991 - DNA, 4215 bp, Homo sapiens
tgaggatccccaaccctgccacccacagcggtgttttcactactcggttggatgcctcagccatagtaagtgggaaagtgagcgagcaagcgagctactagcgaccggaggaaagtgaacagggggagaagggaacagcaagaacaggactccagagcgataaacactcgctggagagggagacgcaggaagcgatgaaagagatgtctgcaaacaccgtgctggacagccagcgtcaacaaaagcattatggaattacctccccaattagtttggcatctcctaaagaaattgatcatatttacacacagaaattaattgacgccatgaaaccatttggagtgtttgaagatgaggaagaattgaaccacaggctggtggttcttggtaaattgaacaatttagtaaaagaatggatttctgatgtcagcgagagtaagaacctcccaccttctgttgtggctactgttggtggtaaaattttcacatttggatcctataggcttggagtacacaccaaaggagctgacattgatgcactttgtgtagctccaagacatgtggaaagatctgatttttttcagtctttttttgaaaaattgaaacatcaagatggcattagaaacttaagagctgtagaagatgcctttgtacctgttataaaatttgaatttgatggtattgaaattgatctagtctttgcaagactggcaatacaaaccatatcagataatttagatctaagagacgactctcgcctgagaagccttgatataaggtgtattcgcagcttaaatggttgtagagttactgatgaaattttgcatttagtgccaaataaagaaacttttagactcaccctaagagctgtcaaattatgggcaaaacgacgtggtatttattccaacatgctaggattccttggtggtgtctcctgggcaatgctagttgcaagaacttgccaattgtatccaaatgcagcagcatctactttagttcataagttctttttagttttttccaagtgggaatggccaaatcctgtgctgctgaagcaaccagaagaaagcaatttgaatttgcctgtctgggatcctcgggtaaatccatcagataggtatcatctcatgcccataatcacccctgcctacccacaacagaattctacgtataatgtgtccacatcaactcgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaagtttattcgacttgaatcaacatttaaggacccccgcactgctgaagaaagaaaaagaaaatcagtggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttgaagcttcct

SEQ ID NO: 68992 - DNA, 3957 bp, Homo sapiens
tgaggatccccaaccctgccacccacagcggtgttttcactactcggttggatgcctcagccataaaacaccgtgctggacagccagcgtcaacaaaagcattatggaattacctccccaattagtttggcatctcctaaagaaattgatcatatttacacacagaaattaattgacgccatgaaaccatttggagtgtttgaagatgaggaagaattgaaccacaggctggtggttcttggtaaattgaacaatttagtaaaagaatggatttctgatgtcagcgagagtaagaacctcccaccttctgttgtggctactgttggtggtaaaattttcacatttggatcctataggcttggagtacacaccaaaggagctgacattgatgcactttgtgtagctccaagacatgtggaaagatctgatttttttcagtctttttttgaaaaattgaaacatcaagatggcattagaaacttaagagctgtagaagatgcctttgtacctgttataaaatttgaatttgatggtattgaagttgtagagttactgatgaaattttgcatttagtgccaaataaagaaacttttagactcaccctaagagctgtcaaattatgggcaaaacgacgtggtatttattccaacatgctaggattccttggtggtgtctcctgggcaatgctagttgcaagaacttgccaattgtatccaaatgcagcagcatctactttagttcataagttctttttagttttttccaagtgggaatggccaaatcctgtgctgctgaagcaaccagaagaaagcaatttgaatttgcctgtctgggatcctcgggtaaatccatcagataggtatcatctcatgcccataatcacccctgcctacccacaacagaattctacgtataatgtgtccacatcaactcgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaagtttattcgacttgaatcaacatttaaggacccccgcactgctgaagaaagaaaaagaaaatcagtggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcagtgcctcctcacttaagtgaacaagcaatcatttagtggcatagatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttgaagcttcct

SEQ ID NO: 68993 - DNA, 4208 bp, Homo sapiens
caggctggaagcggcgccatattggcgtcggccgcgctgtattgtcataaatagagccggttttgtggtgttttcactactcggttggatgcctcagccatagtaagtgggaaagtgagcgagcaagcgagctactagcgaccggaggaaagtgaacagggggagaagggaacagcaagaacaggactccagagcgataaacactcgctggagagggagacgcaggaagcgatgaaagagatgtctgcaaacaccgtgctggacagccagcgtcaacaaaagcattatggaattacctccccaattagtttggcatctcctaaagaaattgatcatatttacacacagaaattaattgacgccatgaaaccatttggagtgtttgaagatgaggaagaattgaaccacaggctggtggttcttggtaaattgaacaatttagtaaaagaatggatttctgatgtcagcgagagtaagaacctcccaccttctgttgtggctactgttggtggtaaaattttcacatttggatcctataggcttggagtacacaccaaaggagctgacattgatgcactttgtgtagctccaagacatgtggaaagatctgatttttttcagtctttttttgaaaaattgaaacatcaagatggcattagaaacttaagagctgtagaagatgcctttgtacctgttataaaatttgaatttgatggtattgaaattgatctagtctttgcaagactggcaatacaaaccatatcagataatttagatctaagagacgactctcgcctgagaagccttgatataaggtgtattcgcagcttaaatggttgtagagttactgatgaaattttgcatttagtgccaaataaagaaacttttagactcaccctaagagctgtcaaattatgggcaaaacgacgtggtatttattccaacatgctaggattccttggtggtgtctcctgggcaatgctagttgcaagaacttgccaattgtatccaaatgcagcagcatctactttagttcataagttctttttagttttttccaagtgggaatggccaaatcctgtgctgctgaagcaaccagaagaaagcaatttgaatttgcctgtctgggatcctcgggtaaatccatcagataggtatcatctcatgcccataatcacccctgcctacccacaacagaattctacgtataatgtgtccacatcaactcgaacagtaatggtagaagaatttaaacaaggtcttgcagtcacagatgaaattcttcaaggaaagtcagattggtccaaactacttgagccaccgaatttctttcaaaagtatagacattatatagtattgactgccagcgcatcaacagaagaaaaccatctagagtgggttggattagtagaatctaaaatccgtgtacttgttggaaacttggaacggaatgaatttattactcttgcccatgtgaatccccagtcattcccagggaataaggaacatcataaagacaacaattacgtatcaatgtggttccttgggataatttttcggagagtagaaaatgcagaaagtgtcaacatagacttgacatatgatatacagtcatttactgatacagtgtacagacaggcaaacaatataaatatgctaaaggagggaatgaaaattgaagcaactcatgtaaagaaaaaacaacttcaccactaccttcctgcagaaattcttcaaaagaagaaaaagcaaagtctctctgatgtcaatcgaagctcgggcggacttcaatccaaaagattgtctctggatagcagttgtctggatagctccagagacactgataatggaacaccttttaattctccagcgtccaagtctgatagcccttctgtaggagaaacagaaaggaatagtgctgagcctgctgctgtaattgtggagaagccactgagtgtaccaccagcccaaggactttccattccagtgattggcgcaaaagttgactctacagtaaaaactgtatcaccccccactgtgtgtaccattcctaccgtagtaggacgaaatgtcattcctagaatcacaacacctcacaaccctgcccagggacaaccgcatctgaatggaatgtcaaatataactaagactgttacacctaagagatcccattccccatccatagatgggactcctaagaggttgaaagacgtagaaaagtttattcgacttgaatcaacatttaaggacccccgcactgctgaagaaagaaaaagaaaatcagtggatgccattggaggagaatctatgcctattccaactattgatacatcacgcaaaaagagactacccagtaaagaactaccagattcatcatctccagttccagcaaacaacatccgtgtcatcaaaaattccattcgactgacccttaatcggtaaaagcaatgcagccacttgttttttaaatagaagtggctgtcatacgtgaaataaggtgaaagtgacagccttcagtctaataaccttgaagtggtttttgaactgtcaaactttgacctgtagatgctgtagcattctctcactgattgctacatacacttctctgaggatcacctgctgtcaaattgccatctacagtattacagctttgcatttgggggttttactgccttaactttcaatgcttgttatgggaaccagttcttagccacttggacactgataacaagtcctgaactccttttttgttttgttttttgtgtttttctttttttgtcttatgttgtaatcattgtatagagctaaaaaaattgaaaacaaacaaaaaaattgtcttgtattttccaaatgttaatacatttactttagcattgaagccactttgaaacctgagataaatgaatgtgaggtatcttttctgctttcctcatttgtgtagatgtactgtctgttctgttgatttaaattatttttttccagattggcacatgaaatatttaaacttttttgtgtgcctttctgtccaaatgttgcatagttaccagggaagattagtccagtgattacataagagttgggcaccataaattctctatattttgcctcccatggaggcctttgaaatgcatctttattaaaaatcaaaatataaccaggatactgaaagtcagtatatgaatggtaaaattgttacatatcctatttcatgccattcttgttagttgactggtattttttactgaggagcaactcattccagcatcaacaataagataacctttaagtatggcacacttgtatttttgaggtgtaaaattaacttggcatgataattcctgatcattatttaccccacaacttcaaatagtttcttcacggactaggcatgcagaaataagcagtggattttattgaaacctaaaggcattttgaatgacattgttaccaaccattaattggctcaggacctttgtaatttttatttaactatatgagttgtctttttttacgctgcttttttcaatgcatttcttaatattttttaagtttcatgaatgcatgctcagtttattaaaatccataaccatgtaattcttgtaatatgttgattcagtgttttgtaaatgaagtcgtatgtattttcagagtatttttgtatgtactgtaagataccatcttttcaaagagaaacgtttaaaacctttattgtctctccttagtctaattttttaaatatggattatgcttgaattactatatttaaaatgaaaatgtatagattacacagccaggaatgctagtatctaccaccttctttagatttcactcagcatttagtaggtccagtaggaaaaacccaaaatggtacattgagtagtgtggggaagacacctcgtgtattataggactcacgggatgccatctagcaagtggagaaatagcagtccattttctcttgcaagccctttaccattgagttgaaattcttgaattgccagagagccgtatcctccaggtcccactcctgttcattgccccttaggtctccaaaatgtaaattctaatgtttaccttgtaccatggaaaacatgaaaagagtcttagaagtaaagaacaacaaggaaaaaaatgtttgttctattattccctttttatatagcagcaaaagataagaataaaatcacataaccaagttgaagcttcct

SEQ ID NO: 68994 - DNA, 233 bp, Homo sapiens
attggcggtagaacagaaaagcatggctggtatctgaaatattctgggattggttccaccactgcttcattccagaagttgaacgatatctctagggcaaaaaccttgctttctgggtcttattaattttggataatgccccagttcattgcacgatgaacttgaaaatgctcaccccaacaaagaagttcttttcatgcccccaatactacatctctcgtccagcccctcag

SEQ ID NO: 68995 - DNA, 4602 bp, Homo sapiens
  misc_feature (3711)..(3711): n is a, c, g, or t
attgagactcaggaccgttttcatggccagagcccacttgtgtgcagcaagaggaaagcacttcgtgtctaacgtagtggaatgagagtaacgtagaagaacaacgaatcccaggtctggcgtttatctcctaggaagggtgtgggagagctgttttccaagggagactctctggaggctgctttgcgcagcaagcagtttttacccagattatatacagtatttcagaccaatttcaaaacctctgcgttttaaaaattgtctttatttacattttacagaaagttgagaaagtgttatttatatggggggtaggggtgctggagattatgagactaataacaaccctcttagctcgcaccctttggcaccactacagcttccaaactctgggactttctcgactagcttccctttgtttagctgtgaaatggaagaagcggtccgggtgtggcggctcatgcctgtaacctgagcactctgggaggcggaggatcgcttgagtccagaagttcaagaccagcttgggcaacatagggtgaccctccaccctccccccgccccaccacatcgctacaaaaaatttttaaaaattagccgggtgtggtggcgcaagcctgtagtctcagcgggagctgagggaggagaatcgcttcagcccgggaggtcgaggctgtagtgagccgagatcgcgctactgcactcctgggcgacagagcgagaccctgtctccaaaaaaaaaaaaaaaagaaaaaagaggaagttgtatccaattcagaaacgcggtccttcgggacctgctagttttataccccggaggatcctccccggcgggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaacgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgaggggaggggagagaggggctcacagagaggaaatggaggcttgcagctggcaagnggcaggacccgccgctcctaactacctgttctctgttgccgcagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggttgcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttccca

SEQ ID NO: 68996 - DNA, 2620 bp, Homo sapiens
aacccaggaggcagaggttgcagtgagtcgagatcacaccattgcactccagcctgggtgatagagtgagacttcatctcaaaaaaaaaaaaaaaaaaaaaaaagaaaagaaaaaaagagttccagaagtagacagggctggagttggaactgggaggaaaagatactcatcccttctctccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaacgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggttgcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttccca

SEQ ID NO: 68997 - DNA, 1430 bp, Homo sapiens
tgcggttgatctagaggatcccacgacaccctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggttgcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttccca

SEQ ID NO: 68998 - DNA, 4170 bp, Homo sapiens
attgagactcaggaccgttttcatggccagagcccacttgtgtgcagcaagaggaaagcacttcgtgtctaacgtagtggaatgagagtaacgtagaagaacaacgaatcccaggtctggcgtttatctcctaggaagggtgtgggagagctgttttccaagggagactctctggaggctgctttgcgcagcaagcagtttttacccagattatatacagtatttcagaccaatttcaaaacctctgcgttttaaaaattgtctttatttacattttacagaaagttgagaaagtgttatttatatggggggtaggggtgctggagattatgagactaataacaaccctcttagctcgcaccctttggcaccactacagcttccaaactctgggactttctcgactagcttccctttgtttagctgtgaaatggaagaagcggtccgggtgtggcggctcatgcctgtaacctgagcactctgggaggcggaggatcgcttgagtccagaagttcaagaccagcttgggcaacatagggtgaccctccaccctccccccgccccaccacatcgctacaaaaaatttttaaaaattagccgggtgtggtggcgcaagcctgtagtctcagcgggagctgagggaggagaatcgcttcagcccgggaggtcgaggctgtagtgagccgagatcgcgctactgcactcctgggcgacagagcgagaccctgtctccaaaaaaaaaaaaaaaagaaaaaagaggaagttgtatccaattcagaaacgcggtccttcgggacctgctagttttataccccggaggatcctccccggcgggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaacgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcctggcggcggtggggctgtgggcaagagagctgctatgcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttcccagaggtgcctggggagtgaactgttttctaaatagaaa

SEQ ID NO: 68999 - DNA, 3555 bp, Homo sapiens
attgagactcaggaccgttttcatggccagagcccacttgtgtgcagcaagaggaaagcacttcgtgtctaacgtagtggaatgagagtaacgtagaagaacaacgaatcccaggtctggcgtttatctcctaggaagggtgtgggagagctgttttccaagggagactctctggaggctgctttgcgcagcaagcagtttttacccagattatatacagtatttcagaccaatttcaaaacctctgcgttttaaaaattgtctttatttacattttacagaaagttgagaaagtgttatttatatggggggtaggggtgctggagattatgagactaataacaaccctcttagctcgcaccctttggcaccactacagcttccaaactctgggactttctcgactagcttccctttgtttagctgtgaaatggaagaagcggtccgggtgtggcggctcatgcctgtaacctgagcactctgggaggcggaggatcgcttgagtccagaagttcaagaccagcttgggcaacatagggtgaccctccaccctccccccgccccaccacatcgctacaaaaaatttttaaaaattagccgggtgtggtggcgcaagcctgtagtctcagcgggagctgagggaggagaatcgcttcagcccgggaggtcgaggctgtagtgagccgagatcgcgctactgcactcctgggcgacagagcgagaccctgtctccaaaaaaaaaaaaaaaagaaaaaagaggaagttgtatccaattcagaaacgcggtccttcgggacctgctagttttataccccggaggatcctccccggcgggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaacgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccagacctagcgccataggatcctctagatcagcctcagcaacactccc

SEQ ID NO: 69000 - DNA, 3209 bp, Homo sapiens
attgagactcaggaccgttttcatggccagagcccacttgtgtgcagcaagaggaaagcacttcgtgtctaacgtagtggaatgagagtaacgtagaagaacaacgaatcccaggtctggcgtttatctcctaggaagggtgtgggagagctgttttccaagggagactctctggaggctgctttgcgcagcaagcagtttttacccagattatatacagtatttcagaccaatttcaaaacctctgcgttttaaaaattgtctttatttacattttacagaaagttgagaaagtgttatttatatggggggtaggggtgctggagattatgagactaataacaaccctcttagctcgcaccctttggcaccactacagcttccaaactctgggactttctcgactagcttccctttgtttagctgtgaaatggaagaagcggtccgggtgtggcggctcatgcctgtaacctgagcactctgggaggcggaggatcgcttgagtccagaagttcaagaccagcttgggcaacatagggtgaccctccaccctccccccgccccaccacatcgctacaaaaaatttttaaaaattagccgggtgtggtggcgcaagcctgtagtctcagcgggagctgagggaggagaatcgcttcagcccgggaggtcgaggctgtagtgagccgagatcgcgctactgcactcctgggcgacagagcgagaccctgtctccaaaaaaaaaaaaaaaagaaaaaagaggaagttgtatccaattcagaaacgcggtccttcgggacctgctagttttataccccggaggatcctccccggcgggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttccca

SEQ ID NO: 69001 - DNA, 3037 bp, Homo sapiens
attgagactcaggaccgttttcatggccagagcccacttgtgtgcagcaagaggaaagcacttcgtgtctaacgtagtggaatgagagtaacgtagaagaacaacgaatcccaggtctggcgtttatctcctaggaagggtgtgggagagctgttttccaagggagactctctggaggctgctttgcgcagcaagcagtttttacccagattatatacagtatttcagaccaatttcaaaacctctgcgttttaaaaattgtctttatttacattttacagaaagttgagaaagtgttatttatatggggggtaggggtgctggagattatgagactaataacaaccctcttagctcgcaccctttggcaccactacagcttccaaactctgggactttctcgactagcttccctttgtttagctgtgaaatggaagaagcggtccgggtgtggcggctcatgcctgtaacctgagcactctgggaggcggaggatcgcttgagtccagaagttcaagaccagcttgggcaacatagggtgaccctccaccctccccccgccccaccacatcgctacaaaaaatttttaaaaattagccgggtgtggtggcgcaagcctgtagtctcagcgggagctgagggaggagaatcgcttcagcccgggaggtcgaggctgtagtgagccgagatcgcgctactgcactcctgggcgacagagcgagaccctgtctccaaaaaaaaaaaaaaaagaaaaaagaggaagttgtatccaattcagaaacgcggtccttcgggacctgctagttttataccccggaggatcctccccggcgggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttccca

SEQ ID NO: 69002 - DNA, 4504 bp, Homo sapiens
attgagactcaggaccgttttcatggccagagcccacttgtgtgcagcaagaggaaagcacttcgtgtctaacgtagtggaatgagagtaacgtagaagaacaacgaatcccaggtctggcgtttatctcctaggaagggtgtgggagagctgttttccaagggagactctctggaggctgctttgcgcagcaagcagtttttacccagattatatacagtatttcagaccaatttcaaaacctctgcgttttaaaaattgtctttatttacattttacagaaagttgagaaagtgttatttatatggggggtaggggtgctggagattatgagactaataacaaccctcttagctcgcaccctttggcaccactacagcttccaaactctgggactttctcgactagcttccctttgtttagctgtgaaatggaagaagcggtccgggtgtggcggctcatgcctgtaacctgagcactctgggaggcggaggatcgcttgagtccagaagttcaagaccagcttgggcaacatagggtgaccctccaccctccccccgccccaccacatcgctacaaaaaatttttaaaaattagccgggtgtggtggcgcaagcctgtagtctcagcgggagctgagggaggagaatcgcttcagcccgggaggtcgaggctgtagtgagccgagatcgcgctactgcactcctgggcgacagagcgagaccctgtctccaaaaaaaaaaaaaaaagaaaaaagaggaagttgtatccaattcagaaacgcggtccttcgggacctgctagttttataccccggaggatcctccccggcgggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaacgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggttgcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttccca

SEQ ID NO: 69003 - DNA, 4541 bp, Homo sapiens
attgagactcaggaccgttttcatggccagagcccacttgtgtgcagcaagaggaaagcacttcgtgtctaacgtagtggaatgagagtaacgtagaagaacaacgaatcccaggtctggcgtttatctcctaggaagggtgtgggagagctgttttccaagggagactctctggaggctgctttgcgcagcaagcagtttttacccagattatatacagtatttcagaccaatttcaaaacctctgcgttttaaaaattgtctttatttacattttacagaaagttgagaaagtgttatttatatggggggtaggggtgctggagattatgagactaataacaaccctcttagctcgcaccctttggcaccactacagcttccaaactctgggactttctcgactagcttccctttgtttagctgtgaaatggaagaagcggtccgggtgtggcggctcatgcctgtaacctgagcactctgggaggcggaggatcgcttgagtccagaagttcaagaccagcttgggcaacatagggtgaccctccaccctccccccgccccaccacatcgctacaaaaaatttttaaaaattagccgggtgtggtggcgcaagcctgtagtctcagcgggagctgagggaggagaatcgcttcagcccgggaggtcgaggctgtagtgagccgagatcgcgctactgcactcctgggcgacagagcgagaccctgtctccaaaaaaaaaaaaaaaagaaaaaagaggaagttgtatccaattcagaaacgcggtccttcgggacctgctagttttataccccggaggatcctccccggcgggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaacgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggttgcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttcccagaggtgcctggggagtgaactgttttctaaatagaaa

SEQ ID NO: 69004 - DNA, 1541 bp, Homo sapiens
  misc_feature (650)..(650): n is a, c, g, or t
taggacagtgccagcacagtggttcccgaccctgcctgcgtgttggaatcacctgggcaccttcagaaaccactgatgcctcagctcacctccaaagattgtgatataattgaactgggtgtggcctgggcttcagaatttataaaagattctccagataatttaagtttcggaactactgacctagcatgtagcgcttattagataatgatagctattgttgcgaggtgctattctaataactgctttacaggtatttactcatttactcattcatctgttcctttaaaactatacggaggcacatgtcctcagtacctcccgaggctgtgtcacaggcatgcatcctttaaaaaaggaagaaaaaaactattgtcattttacagacaaggaaacaggcatagagcggttaagggactcgcccaaggccacaaagctagtgtgtggtgtgagttctggcccgggctgtctgatttcagtccttgcccttaccccctggcctgtgttgcactgagcacttgctgtctgctggtccctgagtgaatgaattctgcatgaataacgcattctttcatttctacctccaaaacctttaggggaggggagagaggggctcacagagaggaaatggaggcttgcagctggcaagnggcaggacccgccgctcctaactacctgttctctgttgccgcagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggttgcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttccca

SEQ ID NO: 69005 - DNA, 4814 bp, Homo sapiens
attgagactcaggaccgttttcatggccagagcccacttgtgtgcagcaagaggaaagcacttcgtgtctaacgtagtggaatgagagtaacgtagaagaacaacgaatcccaggtctggcgtttatctcctaggaagggtgtgggagagctgttttccaagggagactctctggaggctgctttgcgcagcaagcagtttttacccagattatatacagtatttcagaccaatttcaaaacctctgcgttttaaaaattgtctttatttacattttacagaaagttgagaaagtgttatttatatggggggtaggggtgctggagattatgagactaataacaaccctcttagctcgcaccctttggcaccactacagcttccaaactctgggactttctcgactagcttccctttgtttagctgtgaaatggaagaagcggtccgggtgtggcggctcatgcctgtaacctgagcactctgggaggcggaggatcgcttgagtccagaagttcaagaccagcttgggcaacatagggtgaccctccaccctccccccgccccaccacatcgctacaaaaaatttttaaaaattagccgggtgtggtggcgcaagcctgtagtctcagcgggagctgagggaggagaatcgcttcagcccgggaggtcgaggctgtagtgagccgagatcgcgctactgcactcctgggcgacagagcgagaccctgtctccaaaaaaaaaaaaaaaagaaaaaagaggaagttgtatccaattcagaaacgcggtccttcgggacctgctagttttataccccggaggatcctccccggcgggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaacgaccatggcccagtccctgagccccgtcagatcaccatctgcaaccaaagccctgtgcgccaggtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaagggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctcggccagccaacccagatgaaatcggcaactttataattgaggttttattgctctgcaggtctccaccctggcaggaagctcttgccaccggctacagtctggatccagcctggccagttccacctttcccacctacaacacctggcaagaccaagacacagcctttccacaaatacatgagtccatgagcacgtggggtggacaagccatccaatcagtcctcactgactctgagctgggacacctgccttctgcccttaaacatcagaactccagggtctctcgccttttgactctgggatttgtaccagcagccccccagtgttctcaggccttcagcctgggactgaaagtcttggattgggcaatgctaccagcttcctggttctccagcttgtagatggcttatcctaggacttctcagcctccataatcccatgagtcaatttccctaataagtcccctctcatctctctctgtatatatcctattgttctgttcttgggagaaccctgactaatacactgtgtaacatcaggccaatccctttacttctctgtgagtctctgcttccaaatctgtaaaatggtcacgcctgtagacctagcactttgggaggccgagacgagtggatcacttgaggccaggggttcacaactagcctaggcaacataatgagtcctcatctctaataaaaaacaaacagggctcggtgcggtggctcatgcctgtaatcccagcactttcagaagccaaggtgggtagatcacctgaggtcaggagttctagaccagcctggccaacatggtgaaaccccatctgtactaaaaataaaaaaattagccaggcgtggtagtgcatgcctgtaatcccagctactcaggagactgagacaggagaatcgcttgaaatcggaaggcggaggttgcaatgagccgagatcacgccactgcactccagcctgggagaaagagcaaaactccatctccaaaaacaacaacaacaaaaccccaaaatctgtacaatgtatgtatgtattatagcaaacggctgtatgaagactggtgagacaatgcgtactatagtgcactccaataaatagtagctatcacttttatcatacattataatgcaattattggcatccagcacaaagcctgatacataattggctttcaataaataataaataaaacga

SEQ ID NO: 69006 - DNA, 3319 bp, Homo sapiens
attgagactcaggaccgttttcatggccagagcccacttgtgtgcagcaagaggaaagcacttcgtgtctaacgtagtggaatgagagtaacgtagaagaacaacgaatcccaggtctggcgtttatctcctaggaagggtgtgggagagctgttttccaagggagactctctggaggctgctttgcgcagcaagcagtttttacccagattatatacagtatttcagaccaatttcaaaacctctgcgttttaaaaattgtctttatttacattttacagaaagttgagaaagtgttatttatatggggggtaggggtgctggagattatgagactaataacaaccctcttagctcgcaccctttggcaccactacagcttccaaactctgggactttctcgactagcttccctttgtttagctgtgaaatggaagaagcggtccgggtgtggcggctcatgcctgtaacctgagcactctgggaggcggaggatcgcttgagtccagaagttcaagaccagcttgggcaacatagggtgaccctccaccctccccccgccccaccacatcgctacaaaaaatttttaaaaattagccgggtgtggtggcgcaagcctgtagtctcagcgggagctgagggaggagaatcgcttcagcccgggaggtcgaggctgtagtgagccgagatcgcgctactgcactcctgggcgacagagcgagaccctgtctccaaaaaaaaaaaaaaaagaaaaaagaggaagttgtatccaattcagaaacgcggtccttcgggacctgctagttttataccccggaggatcctccccggcgggctggcacgggaggtggagaaagaggcttgggcggccccgctgtagccgcgtgtgggaggacgcacgggcctgcttcaaagctttgggataacagcgcctccgggggataatgaatgcggagcctccgttttcagtcgacttcagatgtgtctccacttttttccgctgtagccgcaaggcaaggaaacatttctcttcccgtactgaggaggctgaggagtgcactgggtgttcttttctcctctaacccagaactgcgagacagaggctgagtccctgtaaagaacagctccagaaaagccaggagagcgcaggagggcatccgggaggccaggaggggttcgctggggcctcaaccgcacccacatcggtcccacctgcgagggggcgggacctcgtggcgctggaccaatcagcacccacctgcgctcacctggcctcctcccgctggctcccgggggctgcggtgctcaaaggggcaagagctgagcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttgcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaacttttccca

SEQ ID NO: 69007 - DNA, 1957 bp, Homo sapiens
  misc_feature (974)..(974): n is a, c, g, or t
  misc_feature (1342)..(1342): n is a, c, g, or t
  misc_feature (1604)..(1604): n is a, c, g, or t
accaagttgcttaacttcgttgagcctctttaggggatgatccatgccctaagctgcctgactgcccaaaagcagaacaatgatgagcaatcatttagacgagataagcacctggagctccaggcattgcctaataaccctgaattattcaatccttcatttcacagacattgattgactgggatttaaaacaatttaaaaatgaatgtgacactggccctgccctcaaagagcttaagagccatctaggtacacaggacatgcccatgcacagctgcaaaataaggcagggtgtgtataatgtatgctgggggtggaagaaccagggaaagttgtcttggcagaggtggcatggcagaaataagcagggaggctactccaactggaggagatggctggagcagggtttgctcctgagtgacgagtagatgaggttggctggagcagatctttggaaggacctgggaagggtttgggggcgggggtggactacagagttggagctaggtggtaaggggccttaaatgtcaggctaagtagccaagatttaatttagcaagtagcgggaagtcatgaagatgtttgagtcagagattcaggtcagtaacctgaccaggactgggctttaggaagaaagtcctctagcatcataagggacagattggtgggggagggtggatttgaggtaggaagaccagttgggagtgatgtaattaagtgaacaagatctaggactaggattcccaaactttgagcataagattcccctgaagtgcccaactttggagatcaattgagaggtcttgcatttgccccctaggaaatggcttttttttttttttttttttttttgagatggattctcactctgttgcccaggctggagtccagtggcatgatctcagctcaccgcaacctctgcttcccaggttcaagtgattcttctgcctcagcctcccaagtagctgggattnctggtgcccaccaccacgcccggctaatttttgtatttttagtagggacggggttttgtcatgttggccaggcttggtcttgaactcctggcctcaagtgatctgcctgccacagcctcttaaagtgctgggattacaggtgtaagccactgcgcccggccaggaagctacattttgataggcaccccaggtgattctgaggcaagtgattgaggaacattgccctacggcaacttgaggtggcgggtggagagcaggatgtgtcggacacctgtggaaatagatttagtagccttggtgttggatccatgccctaagctgcctaagccctaagctgacatggatgtgtccagagtggctgggagaangtggggcggataactgggttgggccatcacaaggagatactggtgggtgggttggtgggagggcaaagtgtgaaaccagtaagctcaaacgcttagaaagagccctgtggggagaaagtactcttgcctgtccagatcttgacagcagagtagaaactggccaggcagcagtcccaatatcaggaggaaccccaaggcttccctgcagagacctccagccccttccttcccctcctgctggccctggggcagaggagcaganggagcagtttttcctgggcagtgtttctgggatgcggtggtggttactcttctgccgatcccacagccttgaaagagccccgtggtggcgggactgaaggtagcaaagctggcgatgtttcaagtgctcaggggagggaagcagagcagggagggaggccccggggagatagaaggctgggattgttcccacagtaaccatctgcgtggccttggggtgggcagggtggggttcagactgaagtcagggacagagcagcaggcatcttggatgtcagagccatgtttttcaggccgggacctgagcaaaccaaaggaaccctcctaattcttcccttttgatggtctcagtcc

SEQ ID NO: 69008 - DNA, 254 bp, Homo sapiens
atcgtgccactgcactgcagcctgggcgacagaggaagactccatctcaaaaacagaaaaaaaaaaaaagtgcagctctctaattgggctcttttacttactatttatataataaaagccacgttcctaggctgtataatggggttaatcatagtaagtaccttgtaaagttacagtgataaccaaataagtgaacataagtaaagcattttacatgtgtgcagcttaataagttggagttgtgactattattt

SEQ ID NO: 69009 - DNA, 560 bp, Homo sapiens
tattatttatcagctaagtacttgataatgattcctgctgtttggtgggactctcaagggaagtaaaaatggtcccaggccaactataataaaactaaggtaaattatattcaaactaaaacttccgacaacactgtgcaaacgggaaatgtcttggtctaaaattcacttatgacggagaatcgctaaggtatgaaatgtttaacaaaatacaagaaatcttattcctgtgaactttctctgctcatctttacatggtaaagtggcctggaaaatttgtttaaatgacctctctaattcagacctcatgtcaccttcatctctattcccaggacccactgagagttatcattgtttaccccaccttgttttttctttgacaacataagcaacaaaagcatttttataaataggtgaagtggctgggaaggagtctacctatatgctgttgtgatgtcgcagactataaaccatcaaacataggcagaataattgtttggtatactggaaggaggataataaaagcacttccactacgaaagaaaattaaatgtgagatg

SEQ ID NO: 69010 - DNA, 384 bp, Homo sapiens
atgaatcattaaatatatcattttaattataaaatttaattatgatgtgaactgttcatatgtagttataaagtcgtctttgtaacttatttatagttgtttagtcataaagcaaaatagtaagattttatgttggggagcagtcaaaatgaagcactttagaatgatgagtggtttttttttttaaggaattccatattctactttgagaactctacctctgattttcatttgatttattttttgaatactcgaagatcccagtgctttcaaccctgagaactgaaatgtgtgatgcatggaatatatctcgagacaataaaatgaaagagttttttacaagggggtttgtggagaaaatatttttgatttgtaaatgctgtg

SEQ ID NO: 69011 - DNA, 214 bp, Homo sapiens
taaaccctttttttcagagtcctcgtatgagtaaaattatgagatcatgaagtatttgtctttctgtgtatgacatttcacttaacatgatatcctcttggtccacccatgttgttgcaaatagcagaattttttttttttttgagatggagtcttgctctgttgcccaggctggagtgcaatggtacgatcttggctcactgcaacctctgcc

SEQ ID NO: 69012 - DNA, 468 bp, Homo sapiens
agccagttaaaggttgggagaggctgagagggctgccctgggactatcacattcccctttgtgaagaaatttaaacagaagctagataaaggcttaaggaggatgttgtggagacttgtagattcgggatagggttggcataggtggctgtgaagtccctccatcctgagattctgtgaaagactttcttcaggccttgcttagaattgctaccagttagtatttagggcaaggattagaacccaggaagagatgttaattatctctttacctctcttagtttttctaacagccttgaatacattcaatatattcccactgcctttcaaatgttcctagtgtgtttgaaaagcatgtgtattatccattgttggcaatctatattttatatgtgatcatttgataaaacttgataaatgtgttgttcaaattttaatttcttgcctgttcaatctgtcaattgtttta

SEQ ID NO: 69013 - DNA, 1127 bp, Homo sapiens
ccggtcaggaaacttccaccttcctccgatttacgtgggctgcatgagcctacttctcttcttattctagtgccagtggcctctggagtcttggtccttcttactggaagtagccctcctctcctgttacagaggcaataattctccagccttccggtcgccgccaaagcctcctgcctaatcacttcctgtattgtctccctgcggctctttgcacagaccttgggctctgtcgtctctggattcttactgatctcttcctcttctcccaaccgccttgtcatgtctctttgagctatgtcaggaggaacggaagggcactttcttactacttttgttagccaaacggacaaactgtcccctcccctttgttgtaaccacacattcaaggcttccttcagtccagccccatctcccttttcgttgcctccctttcactactccaaatgagcttgccatactttaaacgggtcttgtactttcttatcccttctctggaatgtcatttctactgaagaaaatcctactcttccctcaagacccttctttaatcccctcttgccatggaaacttgagattttcattgaggagctaagttggaaaatataaactagagctgagtctctaccctggcactattgacatttggggccagattattcttggttggggagactgttctgtgcactgtaggatgtggagcagcctcccaggcctctacctgccaaaagcacactcccctttccccaagtggtgacaaccaactgtttccagacattgccagatgtcctgaggtgggagtgagggtgaacagaattgcctcccagctgggggctgctggactaatcaacaagaagtggcaaggactgcaggcaaattgcctcagcacttagatttagcactgcaaggccacttcgacaggtggtagtgatttgtgcgtctcatttcctattcttgattgtgacaaggttctggaggatggagacagctacccctgccacagttcccacaggctatgttgtacatagggcttcatatttaacatgtgagtgaatgaaacacatgagcccgagtgctcttcaggacggcaaggcctacatcaagatggtaaaccttcagttcttaaa

SEQ ID NO: 69014 - DNA, 206 bp, Homo sapiens
ggcccctgtggttcccacagggccatgtgtggtctccagggctgagatggctggtgtgggccgccctgacctggtgggtttgggggaacctggccccataggagagtggacagcgccgcggaggaggctgcctacctgccttcctggcccttcctgctctggctggctcagcaggttgagcgcaggtggtggctgtggccctgcca

SEQ ID NO: 69015 - DNA, 986 bp, Homo sapiens
gcttcttctaaatattatctacatttccgaaccaggtccactgaagtcagggggacaaaatgccaaagggtgggacagaagaagggcttaacagttttgagccaagctggaaaaactccaggaggttacaaattggggctctgtgtgacccagggctgtgtgaccctgggcaagcttcttaacctctctgagcctccatgaacctgtctggaaaacgggaatgtctgtcccgtctctatttcctccttggactgtggccagcgtgtaatgtacttagcagcagcggaataaagctccctagtttgatattgttattaatatttccatcttgagcggggagctatgagggaaggcaagggaggtcaacatgtcccaaaagtcctaccagtgcatgggaagggggtgcttcctgagttgtcttcccattttctcatgacccagggcaggtcagagttgacaataccccccacacccaccccaggtgctgggagaggttaaaagcacagagagcttatcatgaatctcaggccttgatgccttggatgtttctagtttccctttcaagtgccctccgtaaagaggtgtaagagaaaggcacccctagatctgtattatactatggggtgggtaggtaggtgtgtgtgtgggggggggggggtgacaaaaggggacgatggtcaggacatgggcctgggcacagactgcagcccaccaggatggggacaccagagagctaggacctgtcacctgggcctccccgggagagctgacaccgcggcctctgaccccacctcccgggaagttcagctgctcagaaccacaaagcaaaacaaaggggcgcggagaggaagaagccgcagtgcctcccaatcaccgccggcgcccgagcccgagcctagctctcccgcggctccttgcccggtcctcccggctggccgcgcaccaaggcccaagcagcccctggtccctcgtctccccgcggccgc

SEQ ID NO: 69016 - DNA, 776 bp, Homo sapiens
tttaaaatagaatatttctgttcagaatatctaattcaacgttatgaaatcaatattttggagttttacttcattcattcagttggtaaatgcttgaccctgacctactgccagattctttgctgagtgctgtggaaacagtgatgtgtaagatactaatggaacttagagaatgttgtgggagacaataatcagataaatattaagatatataagttctaaaagattttaaaaagtactttgaagaagccaactatgatgaaatctgcaggtagacctaatttcaataggtgcaggataatataagctgaagccaaaaagttggaaaagaatattccggcagagcttaggtctgtacttcctgtgtctgggaaatgtccagtgaacaaagaaacaaatgaagcccagtgtggcagaaacttcatgaaagaggggtagaagcaagaggtaaggttgaagaagagggccggagcacggtgtgcagggccttctggcatatgttagagaactagtattttacgttgagtgcaaagagaaatgattaaagacttttaaacaggggggagaggttatttctgaaggactattttataaaaataggcaaaaatggaaattttataaggatgcaataaatggaaaaatttcaaaattctgtcaatactggcctgtctgttgtggcagtgaaggccttggccatagtgaattaataaattaaactaatttgggatatattttggagataggttgataaaacttgatgatgaattaaatgtgtg

SEQ ID NO: 69017 - DNA, 506 bp, Homo sapiens
taaacggagtcttactctgttgcccaggctggaatgcagtggcacgatcttggctcactacaacctccaactcctgggttcaagtgattctcatgcctcagcctcccaagtagctgggattataggtgtgcgccatcatgcctggctaatttttgtatttttagtagacacagggtttcaccatgttggccaggctagcctcgaactcctgacctcaggtgatctgcctgcctcggcctcccaaagtgctgggatcataggcgtgagtgacggtgcctggccctaaatctgaatttaaatgaccataaactggtagtcatcctcaacgaagcaaccaccatgtgcaaagcactataaaagctcctatagggagttaaaaaaagaggcaataacaaacataatcctacaagcaacccataatctacaccatgcctggccaccagctccagaaagccataaaccagcttccccatagaataatcttagccaagcttttgtcattccca

SEQ ID NO: 69018 - DNA, 782 bp, Homo sapiens
  misc_feature (432)..(432): n is a, c, g, or t
cgacagggtctcgctctgtcactagggctagtctcgacctcctagcctcaagcaatcttcctgcctcagtctcccaaagtgccatgattacaggcatgagccactgcccctagcctgcacatattatttttaaaccatacagtggccttgcaaatgtgtgttttcgtccccattttacagatgtagaaactgagggtcaggccaggtgcagtggctcacgcctgtaatcccagcactttgggaggctgaggcaggcagataacctgagatcaggagttcttgaccagcctggccaacatggtaaaaccccatctctactaaaaatacaaaaattagccaggcatggtggcacgtccctgtaatcccagctactggggaggctgaggcaggagaatcgcttgaacctgggaggcagaggctgcagtgagctgngatcgcacgactgcactccagcctgggccacagagcgagactgtgtctaaaaaaaaaataaaaaaagaaaagaaaagaaaaaaaaaaacccaacccggggaacaaattcaaaaaatttcccgaggaaaaatcggggcccggggggctaccactttggagaacccttgcgctccgggtaagataacctctttacttacaatatacttaacccacaacagctctttacatttttcaccaagtttactcagttaaaacttgttttgcaggagatccctggagacccttattaaagggcgtttcctgaatacagggagccgggagtggggccctgagagtcatgaattattaca

SEQ ID NO: 69019 - DNA, 2271 bp, Homo sapiens
  misc_feature (1678)..(1678): n is a, c, g, or t
  misc_feature (1921)..(1921): n is a, c, g, or t
agacgccacgagtcggcggcgctaccgaggggctgtgggcgcgcagctggaacctccggctgtcagtgcgcttacagttcctaaccccgaccctgcgcgcagcccgcactatggcagccccgccgcagctaagggctctgctcgtagtcgtcaacgcactgctgcgcaagcgccgctaccacgctgcgttggccgtgcttaagggcttccggaacggggctgtctatggagccaaaatccgggcccctcacgcgctggtcatgacctttctcttccggaatggcagcctccaggagaagctgtgggccatactgcaggccacatatatccactcctggaacctggcacggtttgtgttcacctacaagggtctccgtgccctgcagtcctacatacaaggcaagacctacccagcacacgcattcctggcggccttcctcgggggtatcctggtgtttggagaaaacaataacatcaacagccagatcaacatgtacctgttgtcacgcgtcctgtttgccctgagccgcctggctgtagagaagggctacatccctgaacccaggtgggacccgttcccgctgctcactgcggtggtgtgggggctggtgctgtggctctttgagtatcaccgatccaccctgcagccctcgctgcagtcctccatgacctacctctatgaggacagcaatgtatggcacgacatctcagacttcctcgtctataacaagagccgtccctccaattaatgcagccctgaggtgtctggctgtggctcaagatttggccccatgcagaccctcccaaaggatactgccttctcaagatcataggcctcagactccaactggtgttatcccagggttccgtttgctgaagtaaaaacactgattttaaaatcccagtgggtacctttgtatggtggcacaagtggccgaatcaggctgaggaatctacggcttggttccagctgtgcagctgacttctgtgagactggggccagccacactactctctaggcctcaggggtcaaggagctcagaggagggccctgaggtctctttccggtgggtatgttcattcttcaactgttcttatgtcacagagggctccttgctggtgggcagtgggttgtaaatactttttaaaaaacactaagttccttatctcagatgctgttctactggagaagttctagattcccactgtccaatagaaacacgtgagccatatatgtaattaaaatgtttctagtagctgcattacaaaaaagaagcctgggcactgtggctcactcctgtaatctcagaactttgggaggctgaggcaggtggatcacttgagctcaggagcttgagaccagcctgggcaacatggtgaaacccagtttctacaaaaaatacaaaaaattagccgggttccatcacctgtggttccagctgaggtgggaggatcacttgagcctatgaggtcgaggctacagtgagcaaagatcacgccactgcactccagcctgggcgacagtgagaccctgtctcaccaaagaaaaaaaaaaaggtgagattaatcttcactatatattttaacacaaatttctaaaagttatttcaacatataattaacatcattagatattttgtactcttttttgtattaagtattcaaaattgggtgtatnttttgccacccacattttcaggacccagtagccacatgtggctagtggctgctgtgacgggcaacacagataacctgagatcaggagttcttgaccagcctggccaacatggtaaaaccccatctctactaaaaatacaaaaattagccaggcatggtggcacgtccctgtaatcccagctactggggaggctgaggcaggagaatcgcttgaacctgggaggcagaggctgcagtgagctgngatcgcacgactgcactccagcctgggccacagagcgagactgtgtctaaaaaaaaaataaaaaaagaaaagaaaagaaaaaaaaaaacccaacccggggaacaaattcaaaaaatttcccgaggaaaaatcggggcccggggggctaccactttggagaacccttgcgctccgggtaagataacctctttacttacaatatacttaacccacaacagctctttacatttttcaccaagtttactcagttaaaacttgttttgcaggagatccctggagacccttattaaagggcgtttcctgaatacagggagccgggagtggggccctgagagtcatgaattattaca

SEQ ID NO: 69020 - DNA, 2072 bp, Homo sapiens
  misc_feature (1479)..(1479): n is a, c, g, or t
  misc_feature (1722)..(1722): n is a, c, g, or t
agacgccacgagtcggcggcgctaccgaggggctgtgggcgcgcagctggaacctccggctgtcagtgcgcttacagttcctaaccccgaccctgcgcgcagcccgcactatggcagccccgccgcagctaagggctctgctcgtagtcgtcaacgcactgctgcgcaagcgccgctaccacgctgcgttggccgtgcttaagggcttccggaacggggctgtctatggagccaaaatccgggcccctcacgcgctggtcatgacctttctcttccggaatggcagatcaacatgtacctgttgtcacgcgtcctgtttgccctgagccgcctggctgtagagaagggctacatccctgaacccaggtgggacccgttcccgctgctcactgcggtggtgtgggggctggtgctgtggctctttgagtatcaccgatccaccctgcagccctcgctgcagtcctccatgacctacctctatgaggacagcaatgtatggcacgacatctcagacttcctcgtctataacaagagccgtccctccaattaatgcagccctgaggtgtctggctgtggctcaagatttggccccatgcagaccctcccaaaggatactgccttctcaagatcataggcctcagactccaactggtgttatcccagggttccgtttgctgaagtaaaaacactgattttaaaatcccagtgggtacctttgtatggtggcacaagtggccgaatcaggctgaggaatctacggcttggttccagctgtgcagctgacttctgtgagactggggccagccacactactctctaggcctcaggggtcaaggagctcagaggagggccctgaggtctctttccggtgggtatgttcattcttcaactgttcttatgtcacagagggctccttgctggtgggcagtgggttgtaaatactttttaaaaaacactaagttccttatctcagatgctgttctactggagaagttctagattcccactgtccaatagaaacacgtgagccatatatgtaattaaaatgtttctagtagctgcattacaaaaaagaagcctgggcactgtggctcactcctgtaatctcagaactttgggaggctgaggcaggtggatcacttgagctcaggagcttgagaccagcctgggcaacatggtgaaacccagtttctacaaaaaatacaaaaaattagccgggttccatcacctgtggttccagctgaggtgggaggatcacttgagcctatgaggtcgaggctacagtgagcaaagatcacgccactgcactccagcctgggcgacagtgagaccctgtctcaccaaagaaaaaaaaaaaggtgagattaatcttcactatatattttaacacaaatttctaaaagttatttcaacatataattaacatcattagatattttgtactcttttttgtattaagtattcaaaattgggtgtatnttttgccacccacattttcaggacccagtagccacatgtggctagtggctgctgtgacgggcaacacagataacctgagatcaggagttcttgaccagcctggccaacatggtaaaaccccatctctactaaaaatacaaaaattagccaggcatggtggcacgtccctgtaatcccagctactggggaggctgaggcaggagaatcgcttgaacctgggaggcagaggctgcagtgagctgngatcgcacgactgcactccagcctgggccacagagcgagactgtgtctaaaaaaaaaataaaaaaagaaaagaaaagaaaaaaaaaaacccaacccggggaacaaattcaaaaaatttcccgaggaaaaatcggggcccggggggctaccactttggagaacccttgcgctccgggtaagataacctctttacttacaatatacttaacccacaacagctctttacatttttcaccaagtttactcagttaaaacttgttttgcaggagatccctggagacccttattaaagggcgtttcctgaatacagggagccgggagtggggccctgagagtcatgaattattaca

SEQ ID NO: 69021 - DNA, 1550 bp, Homo sapiens
agacgccacgagtcggcggcgctaccgaggggctgtgggcgcgcagctggaacctccggctgtcagtgcgcttacagttcctaaccccgaccctgcgcgcagcccgcactatggcagccccgccgcagctaagggctctgctcgtagtcgtcaacgcactgctgcgcaagcgccgctaccacgctgcgttggccgtgcttaagggcttccggaacggggctgtctatggagccaaaatccgggcccctcacgcgctggtcatgacctttctcttccggaatggcagcctccaggagaagctgtgggccatactgcaggccacatatatccactcctggaacctggcacggtttgtgttcacctacaagggtctccgtgccctgcagtcctacatacaaggcaagacctacccagcacacgcattcctggcggccttcctcgggggtatcctggtgtttggagaaaacaataacatcaacagccagatcaacatgtacctgttgtcacgcgtcctgtttgccctgagccgcctggctgtagagaagggctacatccctgaacccaggtgggacccgttcccgctgctcactgcggtggtgtgggggctggtgctgtggctctttgagtatcaccgatccaccctgcagccctcgctgcagtcctccatgacctacctctatgaggacagcaatgtatggcacgacatctcagacttcctcgtctataacaagagccgtccctccaattaatgcagccctgaggtgtctggctgtggctcaagatttggccccatgcagaccctcccaaaggatactgccttctcaagatcataggcctcagactccaactggtgttatcccagggttccgtttgctgaagtaaaaacactgattttaaaatcccagtgggtacctttgtatggtggcacaagtggccgaatcaggctgaggaatctacggcttggttccagctgtgcagctgacttctgtgagactggggccagccacactactctctaggcctcaggggtcaaggagctcagaggagggccctgaggtctctttccggtgggtatgttcattcttcaactgttcttatgtcacagagggctccttgctggtgggcagtgggttgtaaatactttttaaaaaacactaagttccttatctcagatgctgttctactggagaagttctagattcccactgtccaatagaaacacgtgagccatatatgtaattaaaatgtttctagtagctgcattacaaaaaagaagcctgggcacttggctcacgcctgtaatcccagcactttgggaggctgaggcaggcagataacctgagatcaggagttcttgaccagcctggccaacatggtaaaaccccatctctactaaaaatacaaaaattagctggacatggtggcaggcacctgtaattccagctacttgggaggctgaggtgggagaatctcttgaacctggggggctgctgtgagccgagatagttccattacacttcagcctgggtgacagagtaagactctgtctc

SEQ ID NO: 69022 - DNA, 2401 bp, Homo sapiens
  misc_feature (1808)..(1808): n is a, c, g, or t
  misc_feature (2051)..(2051): n is a, c, g, or t
agacgccacgagtcggcggcgctaccgaggggctgtgggcgcgcagctggaacctccggctgtcagtgcgcttacagttcctaaccccgaccctgcgcgcagcccgcactatggcagccccgccgcagctaagggctctgctcgtagtcgtcaacgcactgctgcgcaagcgccgctaccacgctgcgttggccgtgcttaagggcttccggaacggggctgtgtgagtggggccgtcgggccgggctggggctgagggatgtcctgcctggggtcagaggcgcgagttcgaagtccgatgccgcggtgctgtttgccctggagcagtcctcgtgtgtctctaagtctcggagctatggagccaaaatccgggcccctcacgcgctggtcatgacctttctcttccggaatggcagcctccaggagaagctgtgggccatactgcaggccacatatatccactcctggaacctggcacggtttgtgttcacctacaagggtctccgtgccctgcagtcctacatacaaggcaagacctacccagcacacgcattcctggcggccttcctcgggggtatcctggtgtttggagaaaacaataacatcaacagccagatcaacatgtacctgttgtcacgcgtcctgtttgccctgagccgcctggctgtagagaagggctacatccctgaacccaggtgggacccgttcccgctgctcactgcggtggtgtgggggctggtgctgtggctctttgagtatcaccgatccaccctgcagccctcgctgcagtcctccatgacctacctctatgaggacagcaatgtatggcacgacatctcagacttcctcgtctataacaagagccgtccctccaattaatgcagccctgaggtgtctggctgtggctcaagatttggccccatgcagaccctcccaaaggatactgccttctcaagatcataggcctcagactccaactggtgttatcccagggttccgtttgctgaagtaaaaacactgattttaaaatcccagtgggtacctttgtatggtggcacaagtggccgaatcaggctgaggaatctacggcttggttccagctgtgcagctgacttctgtgagactggggccagccacactactctctaggcctcaggggtcaaggagctcagaggagggccctgaggtctctttccggtgggtatgttcattcttcaactgttcttatgtcacagagggctccttgctggtgggcagtgggttgtaaatactttttaaaaaacactaagttccttatctcagatgctgttctactggagaagttctagattcccactgtccaatagaaacacgtgagccatatatgtaattaaaatgtttctagtagctgcattacaaaaaagaagcctgggcactgtggctcactcctgtaatctcagaactttgggaggctgaggcaggtggatcacttgagctcaggagcttgagaccagcctgggcaacatggtgaaacccagtttctacaaaaaatacaaaaaattagccgggttccatcacctgtggttccagctgaggtgggaggatcacttgagcctatgaggtcgaggctacagtgagcaaagatcacgccactgcactccagcctgggcgacagtgagaccctgtctcaccaaagaaaaaaaaaaaggtgagattaatcttcactatatattttaacacaaatttctaaaagttatttcaacatataattaacatcattagatattttgtactcttttttgtattaagtattcaaaattgggtgtatnttttgccacccacattttcaggacccagtagccacatgtggctagtggctgctgtgacgggcaacacagataacctgagatcaggagttcttgaccagcctggccaacatggtaaaaccccatctctactaaaaatacaaaaattagccaggcatggtggcacgtccctgtaatcccagctactggggaggctgaggcaggagaatcgcttgaacctgggaggcagaggctgcagtgagctgngatcgcacgactgcactccagcctgggccacagagcgagactgtgtctaaaaaaaaaataaaaaaagaaaagaaaagaaaaaaaaaaacccaacccggggaacaaattcaaaaaatttcccgaggaaaaatcggggcccggggggctaccactttggagaacccttgcgctccgggtaagataacctctttacttacaatatacttaacccacaacagctctttacatttttcaccaagtttactcagttaaaacttgttttgcaggagatccctggagacccttattaaagggcgtttcctgaatacagggagccgggagtggggccctgagagtcatgaattattaca

SEQ ID NO: 69023 - DNA, 353 bp, Homo sapiens
  misc_feature (173)..(173): n is a, c, g, or t
tctttttacaggggactattgtatgcccttcgtctgacatcagatgaaattaatgttgagatcctactatgtgctagcacttgatggccttaattaaaaatcaggcatttgaattcccaaggactcaggcaaaggtccatgtatcattaagggtgcaagtaacaaaacctagncttgaagaagtgtaaatactagggacacttatttatatttatttcttttatgtttcaagacagagtcttgctctggagtgcagtggcacaatcacggctcactgtaccctctacctcccaagctcaagtgatcctcccacttcagtctcccaagtagctgggactacaggtgtgtgccac

SEQ ID NO: 69024 - DNA, 152 bp, Homo sapiens
cgtcgaccctgcacagctcagcgggagagtgaggatcgggctctttgaggatctcttttatgcctccaatggtcagtgcacttcctgtggtgagagggggctttcgaggtgggtataggatcatggaaagtctttgcaatactgatgctttt

SEQ ID NO: 69025 - DNA, 375 bp, Homo sapiens
aaatggcaattgtctgactggatttgaagtcagatcactgggctttgaagctaatttctggttgaaatatggctgccccatttttagatgtgtgactctgggcaggttaccctatcttcccatcttcaattttcctatctgtaaaatggaactaataacagtacttgctttataattaaatgagctaaaacatgtaatgtactcagaacagtgtctgataaataatacgtgttcagcaaatgttagttttaaaaagtctgctgtcatctgttttatgacctcagtaaagtcatttaacagttcaaagcttctatttcctcatctataaaatggaactactaccacttacttaccctttccaggattaagagactc

SEQ ID NO: 69026 - DNA, 1472 bp, Homo sapiens
gggaaaccagacaccaggaattggtttctctgccttttggcaaaggaataagactacattgacttcatctatgaagacaactgccaactatttcctttgtaaattgctaattttgtgtagtgaggaaaggagcgatgggcgacgtgatttttatggattagactggtgagttctgctgaaagtttgacatctttaggatcttacattttcttcaagttgagctaatgaaaacaggctcgtgactatttatcacctgatttctaagtggatattgggttgaacaccacatatccatgactattaaggaggcttcatggtgtagtttgacaaaggctctctccttgaccaaacttcagtcaggccctaagtcctctttttaaccaggcctccaccttggcccccattcttgatgggcctatacagcccagctttagcaagaatcctgctaagctagtttagagagaatcccacatccccaatatctatgaaatttctcatcccctacttttgatgtgtaagtccttggcctcccttcaacgagaagcctgttaagttcattttgcaagaactctactcttgatatctcctcttagtaatttcctaatcactgaccccctcactctgcccattagttataaacccccacatgttctggttgtattcagagctgagcctgatctcttcctcttgttgggatagttttaaaacctgcgatagttttaaaacctatcactgtagtcctgaattaagtcttccttaccttaacaagtgtcaaaataaatttttctttaacatgttgaagcatgaacttgagaatctagagcaggagtccacaaagtatggcccatgggccatatccagcccgctgccggtttcggtaccactcatgacttaaaaatgggtcttacaattctgagtgattgaaaaaaaatcaaaagaaggataatatttagtgacccatgaaccttatatggcaatcaaatttcagtgtccataaataaagttacattggatgacagccatgcccatttgtttctgtgttgtctgtggctgctcgtgtgctacaatggcagagttgagcagtggtgacaaaccatgtgactcacaaaggcctaaaatatttagcgtctggcccttcgagaaaatgttagctgcccctggtctagagtaggtaaaaggctgagattggaagctgcttgttcaaattctgtgattggaaccgaatgatgtggctcattgtacagctcatggtgaattgcttcagtaccatggttttgttttttccttttgaaaagttggtctataaatgtaaaggaaaaatctaagataccaaaatatgttttctggcttagaatgttttatttccttgtatacattttaagagagtggcaaggagaaaagataatgtatcattttatttgggtttagaataaataatacattttatttatgatcatcatgtttaaaatatt

SEQ ID NO: 69027 - DNA, 373 bp, Homo sapiens
cccattcaacaacatatatcagaatcccctactaccgctagtatttgccaaaaaagaaaagaaacccaccctaagggaagcattggtaacaatcgttgttataaacatggcttgggtatcacatctctccatcttgccatctcttacctgtaagaacggtgactattacaacagtgactattattatatccaaataatctcagcatttgctggagtttgaaccagagctgaatacatggaattttaatgtagaaatttaggcaaaactccaagccattttttcttctcctctggccaaaacgttatttcctcaaacagggaaatatgagtctctatggggccaggttataggagcaaatgtgaacaacctgag

SEQ ID NO: 69028 - DNA, 751 bp, Homo sapiens
acagctgggcctgcagaggccgccatgcgggaggcagaggccgggcctcctcaagtcggcctctccagacccacttgcagcctcccggcgtcctctccgggcccagctcttcctcccggctgcgtctccaggcccgactccggcctcccaacaacctctttggactcagctcctgcccagctcccagtggccctggtaggcccacaacttcctgaagccaagctccccaggcccaggtcaggcctcacggtggcctcgccaggctcagctcctgccctccgatggcatctccaggtcccaaacggcctccggtcggtgggctcctctaggcccagcttgggcctcccggcggcctctgcaggcccaaatcgtcctgaagtcggcctctccaggcccagctccagcctcccggcagcctctgcaggcctaagttgtcctcaagtcggcctggaagtgggcctggaagagctgcaagttggcctccctgggcccagctccgtcctcttggcctctccaggtgcaaaacttcctcgagtcagcctctccaggcccagctcctcctgcctcccagtggcctcttttggcccagcccagctcatggctctcagcagccttcccaggccccgcttttgacttttggtggcctcttcaggcccagaacttgacctccagtcggcctttgcaggcccggcttcctgcctctcgaaggcctgcacgggcccagcctcagcctcacagcggactctccacg

SEQ ID NO: 69029 - DNA, 912 bp, Homo sapiens
acagctgggcctgcagaggccgccatgcgggaggcagaggccgggcctcctcaagtcggcctctccagacccacttgcagcctcccggcgtcctctccgggcccagctcttcctcccggctgcgtctccaggcccgactgctgcctcccaacaacctctttggactcagcgcctgcgatctcctggcggccttggtcggcccacagcttcctcaagccaagctccccaggcccaggtcaggcctcacggtggcctctccaggatcagctcttcctcccggctgcgtctctaggcccgactccggcctcccaacaacctctttggactcagctcctgcccagctcccagtggccctggtaggcccacaacttcctgaagccaagctccccaggcccaggtcaggcctcacggtggcctcgccaggctcagctcctgccctccgatggcatctccaggtcccaaacggcctccggtcggtgggctcctctaggcccagcttgggcctcccggcggcctctgcaggcccaaatcgtcctgaagtcggcctctccaggcccagctccagcctcccggcagcctctgcaggcctaagttgtcctcaagtcggcctggaagtgggcctggaagagctgcaagttggcctccctgggcccagctccgtcctcttggcctctccaggtgcaaaacttcctcgagtcagcctctccaggcccagctcctcctgcctcccagtggcctcttttggcccagcccagctcatggctctcagcagccttcccaggccccgcttttgacttttggtggcctcttcaggcccagaacttgacctccagtcggcctttgcaggcccggcttcctgcctctcgaaggcctgcacgggcccagcctcagcctcacagcggactctccacg

SEQ ID NO: 69030 - DNA, 149 bp, Homo sapiens
gtaatgacactcctgccactgatgataacaccatatatttgcatagagcgttctagtttacaaatattgacttgcccagtgttgctcacaggtcagactctttagacacagatctgattctaaggctacaaggttatagctcatttaag

SEQ ID NO: 69031 - DNA, 677 bp, Homo sapiens
acctggctaattttttgtatttttagtagagaaggggtttcaccatgttagccaggatggtcttgatctcctgacctggtgatccacccgcctcagcctcccaaagtgctgggattacaggcgtgagccaccacgcccagcctgatttgagtgtattttctaaataaaaattgaattgctatttaggttattccagtaccagcatgtgggctgttaaatctttagatatggccttttaaggtttttttttaaatatgttattctatcaattagtatttttcaaactgatcaaaaactaaaacagtttcagatttcctatctaaagtttacattttttatatataccaggtggttgtgagagctttgatcaaaacaaccttacccactttgaatgtgtttcttgtctgcctgatgatctggctgatttttagtatcatgggagtagacttatttgctggcagattctatgaatgcattgacccaacaagtggagaaaggtttccttcatctgaagtcatgaataagagtcggtgtgaaagccttctgtttaacgaatccatgctatgggaaaatgcaaaaatgaactttgataatgttggaaatggtttcctttctctgcttcaagtagtaagtacacttttgacttttccttattaattatatattcatccatattg

SEQ ID NO: 69032 - DNA, 5389 bp, Homo sapiens
gcggccgcgcaagtcctccaccatgtgaatgccaacatggccaggtcattagagctgagggaaaactagtgcccaaagatatgaaaagagtgtggatcttctggagaagtgctgttgttcaacaggtacaaaattggaaatgttggcttcaccagaacctaagggccttgttcccttcactaaagagtcttttgaacttataaaacagcatattgctaaaacacataatgaagaccatgaagaagaagacttaaagccaaatcctgatttggaagttggcaaaaagcttccatttatttatggaaacctttctcaaggaatggtgtcagagcccttggaagatgtggacccatattactacaagaaaaaaaatactttcatagtattaaataaaaatagaacaatcttcagattcaatgcggcttccatcttgtgtacattgtctcctttcaattgtattagaagaacaactatcaaggttttggtacatccctttttccaactgtttattctaattagtgtcctgattgattgcgtattcatgtccctgactaatttgccaaaatggagaccagtattagagaatactttgcttggaatttacacatttgaaatacttgtaaaactctttgcaagaggtgtctgggcaggatcattttccttcctcggtgatccatggaactggctcgatttcagcgtaactgtgtttgaggttattataagatactcacctctggacttcattccaacgcttcaaactgcaagaactttgagaattttaaaaattattcctttaaatcaaggtctgaaatcccttgtaggggtcctgatccactgcttgaagcagcttattggtgtcattatcctaactctgttttttctgagcatattttctctaattgggatggggctcttcatgggcaacttgaaacacaaatgttttcgatggccccaagagaatgaaaatgaaaccctgcacaacagaactggaaacccatattatattcgagaaacagaaaacttttattatttggaaggagaaagatatgctctcctttgtggcaacaggacagatgctggtcagtgtcctgaaggatatgtgtgtgtaaaagctggcataaatcctgatcaaggcttcacaaattttgacagttttggctgggccttatttgccctatttcggttaatggctcaggattaccctgaagtactttatcacctgatactttatgcttctgggaaggtctacatgatattttttgtggtggtaagttttttgttttccttttatatggcaagtttgttcttaggcatacttgccatggcctatgaagaagaaaagcagagagttggtgaaatatctaagaagattgaaccaaaatttcaacagactggaaaagaacttcaagaaggaaatgaaacagatgaggccaagaccatacaaatagaaatgaagaaaaggtcaccaatttccacagacacatcattggatgtgttggaagatgctactctcagacataaggaagaacttgaaaaatccaagaagatatgcccattatactggtataagtttgctaaaactttcttgatctggaattgttctccctgttggttaaaattgaaagagtttgtccataggattataatggcaccatttactgatcttttccttatcatatgcataattttaaacgtatgttttctgaccttggagcattatccaatgagtaaacaaactaacactcttctcaacattggaaacctggttttcattggaattttcacagcagaaatgatttttaaaataattgcaatgcatccatatgggtatttccaagtaggttggaacatttttgatagcatgatagtgttccatggtttaatagaactttgtctagcaaatgttgcaggaatggctcttcttcgattattcaggatgttaagaattttcaagttgggaaagtattggccaacattccagattttgatgtggtctcttagtaactcatgggtggccctgaaagacttggtcctgttgttgttcacattcatcttcttttctgctgcattcggcatgaagctgtttggtaagaattatgaagaatttgtctgccacatagacaaagactgtcaactcccacgctggcacatgcatgactttttccactccttcctgaatgtgttccgaattctctgtggagagtgggtagagaccttgtgggactgtatggaggttgcaggccaatcctggtgtattcctttttacctgatggtcattttaattggaaatttactggtactttacctgtttctggcattggtgagctcatttagttcatgcaaggatgtaacagctgaagagaataatgaagcaaaaaatctccagcttgcagtggcaagaattaaaaaaggaataaactatgtgcttcttaaaatactatgcaaaacacaaaatgtcccaaaggacacaatggaccatgtaaatgaggtatatgttaaagaagatatttctgaccataccctttctgaattgagcaacacccaagattttctcaaagataaggaaaaaagcagtggcacagagaaaaacgctactgaaaatgagagccaatcacttatccccagtcctagtgtctcagaaactgtaccaattgcttcaggagaatctgatatagaaaatctggataataaggagattcagagtaagtctggtgatggaggcagcaaagagaaaataaagcaatctagctcatctgaatgcagtactgttgatattgctatctctgaagaagaagaaatgttctatggaggtgaaagatcaaagcatctgaaaaatggttgcagacgcggatcttcacttggtcaaatcagtggagcatccaagaaaggaaaaatctggcagaacatcaggaaaacctgctgcaagattgtagagaacaattggtttaagtgttttattgggcttgttactctgctcagcactggcactctggcttttgaagatatatatattgatcagagaaagacaattaaaattttattagaatatgctgacatgatctttacttatatcttcattctggaaatgcttctaaaatggatggcatatggttttaaggcctatttctctaatggctggtacaggctggacttcgtggttgttattgtgttttgtcttagcttaataggcaaaactcgggaagaactaaaacctcttatttccatgaaattccttcggcccctcagagttctatctcaatttgaaagaatgaaggtggttgtgagagctttgatcaaaacaaccttacccactttgaatgtgtttcttgtctgcctgatgatctggctgatttttagtatcatgggagtagacttatttgctggcagattctatgaatgcattgacccaacaagtggagaaaggtttccttcatctgaagtcatgaataagagtcggtgtgaaagccttctgtttaacgaatccatgctatgggaaaatgcaaaaatgaactttgataatgttggaaatggtttcctttctctgcttcaagtagcaacatttaatggatggatcactattatgaattcagcaattgattctgttgctgttaatatacagcctcattttgaagtcaacatctacatgtattgttactttatcaactttattatatttggagtatttctccctctgagtatgctgattactgttattattgataatttcaacaagcataaaataaagctgggaggctcaaatatctttataacggttaaacagagaaaacagtaccgcaggctgaagaagctaatgtatgaggattctcaaagaccagtacctcgcccattaaacaagctccaaggattcatctttgatgtggtaacaagccaagcttttaatgtcattgttatggttcttatatgtttccaagcaatagccatgatgatagacactgatgttcagagtctacaaatgtccattgctctctactggattaactcaatttttgttatgctatatactatggaatgtatactgaagctcatcgctttccgttgtttttatttcaccattgcgtggaacatttttgattttatggtggttattttctccatcacaggactatgtctgcctatgacagtaggatcctaccttgtgcctccttcacttgtgcaactgatacttctctcacggatcattcacatgctgcgtcttggaaaaggaccaaaggtgtttcataatctgatgcttcctttgatgctgtccctcccagcattattgaacatcattcttctcatcttcctggtcatgttcatctatgccgtatttggaatgtataattttgcctatgttaaaaaagaagctggaattaatgatgtgtctaattttgaaacctttggcaacagtatgctctgtctttttcaagttgcaatatttgctggttgggatgggatgcttgatgcaattttcaacagtaaatggtctgactgtgatcctgataaaattaaccctgggactcaagttagaggagattgtgggaacccctctgttgggattttttattttgtcagttatatcctcatatcatggctgatcattgtaaatatgtacattgttgttgtcatggagtttttaaatattgcttctaagaagaaaaacaagaccttgagtgaagatgattttaggaaattctttcaggtatggaaaaggtttgatcctgataggacccagtacatagactctagcaagctttcagattttgcagctgctcttgatcctcctcttttcatggcaaaaccaaacaagggccagctcattgctttggacctccccatggctgttggggacagaattcattgcctcgatatcttacttgcttttacaaagagagttatgggtcaagatgtgaggatggagaaagttgtttcagaaatagaatcagggtttttgttagccaacccttttaagatcacatgtgagccaattacgactactttgaaacgaaaacaagaggcagtttcagcaaccatcattcaacgtgcttataaaaattaccgcttgaggcgaaatgacaaaaatacatcagatattcatatgatagatggtgacagagatgttcatgctactaaagaaggtgcctattttgacaaagctaaggaaaagtcacctattcaaagccagatctaataccacttaccacctcttttcatatttcttcacatatctgaaaaatgttgaaagcctaagccaggaataaaagaaaagtagagataataatcagttctttacaaccgatggtaattaagcttgtattcacaagacttcatgccaaattcactttttagcattatatctaacaaatcaagagaatccttaatattgctgcag

SEQ ID NO: 69033 - DNA, 484 bp, Homo sapiens
aattaaacttcatctccatttcccataggaagaaactgaggacaggaggggccaaacaagttacagtttcatccctccagagagccaacagagtattttgcacgaagttgaagctaaacaggtattatgtcctatctctggactgaatgactagatgctactcagcttctgaactagaggaagcctgggaccttgaccgcactaatgctgatgacagcggatttgcaagtggctagaggtaccagatttagcaaatcaaaatataggacgtcaagttaaatttaagtgtaagataagctacgaataccttttctagtattagtacgtcccatgcaatatactagaaatgttattcgttatttatgttaaatttaattttattagggcatcctatattttacctgtcaatccaacccatgacctaggcagacactgtagaaaaacaaaaggagaattaaggagataaatgaaacacagggtgagc

SEQ ID NO: 69034 - DNA, 136 bp, Homo sapiens
ccaaatgcccggatgcaacaatcagttcttagaaaggcatgtgaaccaatccaagccaaaaatatgcaatcctctgacgttactggaaactgttagaaaaaggaggtatggtctggacttaaactcaagaaaatat

SEQ ID NO: 69035 - DNA, 1404 bp, Homo sapiens
tttgtttgtttttgagaacagggtcttgctctgttgcccaggttggagtgcagtggctcgatcacagctcacttcagcctccacctcctggacttaagagattctcccacctcagcctgttgagtagctgggactacagatgtgcatgccaccaacactctgctaatttttctactttttatagagatgagatttcaccaagttgcccaggctggtctcgaacctctgggctcaaagaattagggctcaagcagttctcccacctcagcctcctgaagtggtgggattacaggcaaagaaaagatagtctggaaaagttacttgctaaaaggcttgattaaactaaatgtgtcctctttgttaacctttgattgtttgattatatttttcttaaaatttatctttttaaaataattttttaaaaattttaatagatatgaggtctctctctgttgcacaagctggtctcgaactcctgaactcaggtaatcctctcacctcagcctcccgaagtgctaggattgcagatgtgagccaccacacccagccaaaatttcttaactacatataaattatcttaatgatctaggtattttgttaggggaatacatacagtcaggataggataagaggggaagtaatgagtggtttactaaatatataagacaaacatttcaagtaaaaatttcaggagaaaatttttttttaggtttctaagaaatatatttgtggatgtggaatttttctgtcagatgacgtaagagcaaagttgaagatagctaatacttggggattcatatggaggtaattttttatttaaaatgagcaagaaggaccctagccttttattgtggtcttggaaactcattccccaccagtatcattccttgaagaaatggttggttctaggtctggggcaggaaatatatgagataagctgaaacatcttgactatcagcaaagattttatcaaacgatgctagggttgtgtcagaaggactcagcagccaactgaagacgttcccactggccaaaatagggcacattgagtatctgtaaagataactgcatggatcaaaacacatcaaaagctgggcacagtggctcatacctgtaatcccagcactttgggaatctgaggcgggtgtgttgcttgagtccaggagtttgagaccagcctggggaacatggtgggaccccctctctaccaaaaaaaaaaaaaaaaaaaaaaaaaaattagccagacatggtggctcttggttatcccaagagttagttagctctttgtcccaagagttactcaagaggttgaggtgggaggatttcttgagcctgggaggtggaggttgcggtgagctgggattgtgccactgtactccagcctggatgagaccacatctcaca

SEQ ID NO: 69036 - DNA, 181 bp, Homo sapiens
tgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccacca

SEQ ID NO: 69037 - DNA, 452 bp, Homo sapiens
caacacaataacctaagtatctatgtggcaggatatctcttttagagtatcacagcgtttaatccttacatttttttctataaaacattttttatgattacttggaaaaagatacaaaagaacataatttggtgtaattatttcaatgaagctaatgagatttcctgccacacagatgaatacagagcattaccttcataactgttataacctgttgtggcagatgacatctggagtatttgtcctggtctgagcaatacattataaaattggtttagaaaaatttgcagcagagattagtatggctagatctgcctggaaaatgacctgtgaaggaaagttaagaaaaaaatgtatgtttaacttgggaaaaaaaaaattttggaagcagggcctgtgatacagtttggatatttgtccctgcccaaatctcatgttgaattgtaatcccc

SEQ ID NO: 69038 - DNA, 221 bp, Homo sapiens
atctttaggaaacattctctaaactgtctacatactcctgatccagctgaaatgcttcatagattcaagcccatttgctgggatttggacctaagattattgaggtgagggattcccagggaaggtgaactctgttatgtgctgataaggtctggccctagtagtaagacatttgcctagagtgctattctttaaaaattccaaccccaaacatcagcagt

SEQ ID NO: 69039 - DNA, 395 bp, Homo sapiens
tgttcaaggacatcaacttcaggaggctggaggcaaacatgctggagccccctttctgtcctgatcctcatgccgtttactgtaaggacgtcctggatatcgagcagttctcggcggtgaaagggatctacctggacaccgcagatgaagacttctatgctcggtttgctaccgggtgtgtctccatcccctggcagaatgagggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagacctttctgcactaatac

SEQ ID NO: 69040 - DNA, 353 bp, Homo sapiens
ggggacttggctgtctgatctatgaaatgattcagggacattctccattcaaaaaatacaaagagaaagtcaaatgggaggaggtcgatcaaagaatcaagaatgataccgaggagtattctgagaagttttcagaggatgccaaatctatctgcaggatgggctgcctgaccatggtccccagtgagaaggaagtggaacccaagcaatgctgagcaccccggtgcggaccacagagcagaccctggcgccaggaaggagcatgtgttagcgtctcgtcccacctggaattgtaataaatacatctaaataaaacatgccttgggagtgtacagacctttctgcactaatac

SEQ ID NO: 69041 - DNA, 1105 bp, Homo sapiens
gattggctataagaggagcttgatcgtgggtgcaccctggaccccaccatggctcaccggccccccagccctgccctggcgtccgtgctgctggccttgctgctgagcggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacataccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactccccctggctcctgtctgtccttcccatatagggaggggagggggaactgcccaccgtgacctcaataaacgttgaaactcc

SEQ ID NO: 69042 - DNA, 11595 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccccgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctta

SEQ ID NO: 69043 - DNA, 9049 bp, Homo sapiens
  misc_feature (1)..(1): n is a, c, g, or t
  misc_feature (8)..(8): n is a, c, g, or t
  misc_feature (11)..(12): n is a, c, g, or t
ncagaggnttnncaaaagtgcactcttctatatctgcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccccgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctta

SEQ ID NO: 69044 - DNA, 11443 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccccgtctccacgtttgtttccccagtgtctggcggggagccaggtgacatcataaatacttgctgaatgaatgcaga

SEQ ID NO: 69045 - DNA, 11448 bp, Homo sapiens
  misc_feature (11409)..(11409): n is a, c, g, or t
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccccgtctccacgtttgtttccccagtgtctggcggggagcgtntgcattcattcagcaagtatttatgatgtcacgtcgacg

SEQ ID NO: 69046 - DNA, 10729 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttgga

SEQ ID NO: 69047 - DNA, 6005 bp, Homo sapiens
tcacctccggctactttatctgtgtgtgtggtttcccctgatgtctgtgtgagcttcttcagggctgagagcaccttctgtacgtcccttttctccaaaggtgtcttgggctgccttcttgtgcttgttggggtgtctgctgattctggtggagaagattcgcagggcattttagtagttttgccagcagccactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccccgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctta

SEQ ID NO: 69048 - DNA, 4448 bp, Homo sapiens
  misc_feature (1)..(1): n is a, c, g, or t
  misc_feature (8)..(8): n is a, c, g, or t
  misc_feature (11)..(12): n is a, c, g, or t
ncagaggnttnncaaaagtgcactcttctatatctcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccccgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctta

SEQ ID NO: 69049 - DNA, 10800 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgaaaaaaaaaaaaaaaaaaaaaaaaaaaaaaaaaaaaaaaaaaaaacgaaacaaaaaaagagagggggggggggcgcgcaaaatagaatatcccccccggaggggggcgccaataataccggcctcacccaggtttttgtgagcaaaggggggcgcccccaaaagggggacggcggtaattaaaaagacaagcgggacggggcggcggagtaaaaaacacgcggtgggcgcggagaaaagaccggccatacaggaggcactttgggaaggaacgcccactcttccgggggggagcacattagggggacaacccactcggagaggatatttaaggagtcgaggggaaaataacacttcggggcgtgtacgtggggtaccaccacgggaatatgagggggcgtagaaaaagttgggtcagggagtattatttaggacaatttttacgtggtgtgaatataatggttagatgtagaaggatgctagcaagtaatggatagcagtacatgagagatatagtagaatgagagagagagtaactgataacaaggcatactaatcaagataggtaaagaagataatagtagaagagaagtaatcggaactagtaata

SEQ ID NO: 69050 - DNA, 2522 bp, Homo sapiens
aactacggctaggtagaggcctgggtctaatcggccgagtaagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccccgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctta

SEQ ID NO: 69051 - DNA, 7368 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagctctcgcctggactagagtgg

SEQ ID NO: 69052 - DNA, 7145 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactactggtttgacctgcagtgcgtctgcctctacaccccactaggcgtggtgcgctgcccgcgcgtcaggaagaacagcagcacggaccagggcagcgacgaggagggcagcctgcagaagga

SEQ ID NO: 69053 - DNA, 6256 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaagttcagagccaggcctaacttccgagccagtcctaagttcagatca

SEQ ID NO: 69054 - DNA, 2443 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaaaataaaataagctcatctgatgctagtgcgaat

SEQ ID NO: 69055 - DNA, 12675 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccccgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctta

SEQ ID NO: 69056 - DNA, 12599 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccccgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctta

SEQ ID NO: 69057 - DNA, 10129 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagaactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccccgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctta

SEQ ID NO: 69058 - DNA, 7123 bp, Homo sapiens
  misc_feature (74)..(74): n is a, c, g, or t
cctctgagatgaagcttccagaggaaggatcaggcagcaatatttgctgttctgcaatatttgctgttccgcanatatttgctgttccgcagcctctgctggtgataccctggaaaacagggtctggagtggaactccagcaaactccaatggacctgcagctgagggacctgactgttagaaggaaagctaacaaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccccgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctta

SEQ ID NO: 69059 - DNA, 11435 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctta

SEQ ID NO: 69060 - DNA, 5962 bp, Homo sapiens
ctgaggatccccgacgtttctctggtaggccgttgctgtgcttgctgggggtgtccacggggtctgggcggtggagattggcaggctatttgggtagttttctcatcagtcgtgggctggtcagtgcctggtgtctggaagagctctttgaagccagccaggtcttctagagcctgggccttttccttaggagttggtggccatctttggctgccaggtaaatttccgggcaggtccaatttctgcacgggagttcccataaaggctttcaggtctttctcatcacctccggcgggttggggtgtgtccatagctttccctacggatggtgttcgtttcctgacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccccgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctta

SEQ ID NO: 69061 - DNA, 4253 bp, Homo sapiens
tccccctggggtgttattcaaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccccgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtctta

SEQ ID NO: 69062 - DNA, 9211 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgtaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccagtcgcatattccacatcacccaactaaaaatattaaacagggtaccgagct

SEQ ID NO: 69063 - DNA, 2763 bp, Homo sapiens
gggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggaggagaaagagtggcaacctgccttcaaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggtaaaaacgtagtcttagatcttataaatcttttgactctactgttttttactgtgttaatgtttgttttgctaactttgtttatctgctgtgaaagagattataaaataaacgactcaatcaccct

SEQ ID NO: 69064 - DNA, 1610 bp, Homo sapiens
  misc_feature (1245)..(1245): n is a, c, g, or t
agcgcctctacttggctgccccgtctgggaaatgggaagcgcctctgcccggccgccccgtctgggaagtgaggagcacctctgcccggccgccaccccgtctgggaagtggggagcacctctacctggccgccccgtctgggaaatgggaagcgcctctgcccggccgccccgtctgggaagtgaggagcgcctctgcccagctgccaccccgtctgggatgtgaggagcgcctctgcctggctgccccatctgggaagtggggagcgcctctacctggctgccccatctgggaaatgggaagcacctctgcccggccaccccatctgggaagtgaggagcgcctctgcccagctgacaccccatctgggatgtgaggagcacctctgcccggccgccccgtctgggaagtgaggagcgcctctgcccggccgccccgtctgggaagtgaggagcgcctctgcccggccgcccatcgtctgggaagtgaggagtgtctctgcccggccaccccgtctgggaagtgaggagcgcctctgcccggctgccccgtctgggaggtgaggagcgtttctgcccggccgcccatcatctgggaagtggggagcccctctgcccggctgccccgtctgggaagtggggagcgcctctgcccagccaccccatctgggaagtgaggaacgcctctgcccggccaccccgtctgggaagtggggagcgcctctgcctggccgcccatcgtctgggaagtggggagcgcctctacctggctgccccatctgggaaatgggaagcgcctctgcccggccaccccatctgggaagtgaggagcgcctctgcccagctgacaccccatctgggatgtgaggagcacctctgcccggccgccccgtctgggaagtgaggagcgcctctgcccggccgccccgtctgggaagtgaggagcgtctctgcccagccacccatcgtctgggatgtgaggagcgcctctgcccggccaccctgtctgggaagtgaggagcacctctgcccggccgccctatctgggaggtgtacccaatagctccgaagagacagcgaccatcgagaacgggccatgatgacgatggcggttttgtcgaaaagaaaagggggaaatgtggggaaaagaaagagagatcagattgttactgtgtctgtgtagaaagaagtagatataggagactccattttgttctgtacttagaaaaattcttctgccttggnatgctgttaatctataaccttacccccaaccctgtgctctctgaaacatgtgctgtgtcaactcagggttaaatggattaagggcagtgcaagatgtgctttgttaaacagatgcttgaaggcagcatgctcgttaagagtcatcaccactccctaatctcaagtacccagggacacaaacactgtgtaggaaaaccagagacctttgttcacatgtttatctgctgaccttctctccactattatcctatgaccctgccacatccccctctccgagaaacacccaagaatgatcaataaacattaaaaaaaaaagtacaagaaaaaaaaaaagaaataataaatgcttatttttgttttaagcc

SEQ ID NO: 69065 - DNA, 425 bp, Homo sapiens
gaataattccacttcctgctgtgatagagaacaggactcccagaagccggatcttgcacaagccctttcctcagtttccccatctataaaataaggtagctggaactagaatcaccaaggctttttcagcccttgggttctttggttctctctctcttacacacatatgtgaaggtgcacaatgtgctgtgttcttacacacaaacacatttctacatcttgctgacaatctctttccatctatcggttggaagccctgattccgcctccaatctcctgcacttctgacatcactccctctgcaggcctcctttatgactaaatccagccattaagcttcaaatgagttacctgctggcattgtgtaagggcagccagcagatttagtcacctaatcgcctctcttatcagtgttctctcccagc

SEQ ID NO: 69066 - DNA, 308 bp, Homo sapiens
tggtaaatactagagaagagaacatggaatcttcagcttgataatacacttaacattccttcagtgtagaactcctacacacttctacaggagtttcctcagggcctattccctgagaagatagacaactttaatatcattgttctactaatacaggattcattagttttaaagaaacatcaattcccctagctctggattggcaactcataaaaagaaatatcccttaggagagctctgtatacatctgcttcattatgaagttgtatccacttcaattttttcctattaatatagatatgcatgag

SEQ ID NO: 69067 - DNA, 343 bp, Homo sapiens
tgaaaaatgcttacaatttcatgttgtctaaccacaaaaatgttaccaatatgagacaaagcattaatcacatagaactaagcatttgacaatgtatatacacttcaaaatgttgttttataaaataaatattttgtcaagttaaaaatatatttttagacactatagaaggataacaatgttccaaatactgtctgtttcttttataaaacttagcagtatcctatcgtacagtttttcagctgttttgccagtcataaccataggaacgttgatgttcaacagcatgttctgaacccagcacagggcatgggagaagccaatgactttagggcttttattt

SEQ ID NO: 69068 - DNA, 683 bp, Homo sapiens
tttatttttctctcctagagaaatatacctacctgtcactaaaatacatgtcaagttacataatctgttaagtgtgaatctttttgtgttcctttccaagtttggaagcagaagagagacaacggagtaggcagatggagaaacaaatattgactttattactaaataaatctggtattggaataggattcctaaagctgagtcccaaaatgagactgatttgctgttctaacagaaaccagaagattcagtgagaagcgtcagaagcatctccctaacatgagaaatgaaacttttgaaaacatcaccaaagttgttcctgtcttgtactacagggctctctctactgacttgagatctcaggagaaatcatgactcctttcgcctcacctggctgaaccacctggatgtctttccatcattctctgtctattattaccctatagaatgaccttctttcttatatgtgttcaggaagggcaaaaaaaaaaatctcctagatgtatttctctctttttaaaaactgtaagtactcagaacaataccaagaaaaatacaaaagcaaagctttttatagctaattagaaacttccttgcaattctgaagtgtatgtgatattgtgtattgttacaataatacacaatattattaaagtatatgtgatattatgtattgtttaccc

SEQ ID NO: 69069 - DNA, 313 bp, Homo sapiens
attttacttcaacagtggaaactatgacacaacagggatggtctaaccccaatttgagcactctgttctcattttcattaggaatcacttccctgtaatcataaaatggaaatatatttactgtagacatgttgtttggtgaaagcaacactaaaaatgagtagatgaatataacagctacaggataaaataagagttcccatttttaaaaagaaggactatgtttacaacacagctctccttaatgttatagtgttattatagcagtgaattttcaaataaaatatttaaattggaatgttagaagttttct

SEQ ID NO: 69070 - DNA, 223 bp, Homo sapiens
tttcttaatggtaagtgaaatgaacatgagttgattcttactttggcctgaggaaagctttgtcacagctactctaggagctactgtttcttgaacacaatttcccaagtgaaggtacggcttgggcagggagttttgagtacctgcataaggtcatgtagctagcgggtgagagagctgcaatgaacacaggtctcattggttcctggatatgtgttctttc

SEQ ID NO: 69071 - DNA, 542 bp, Homo sapiens
gatcacaggtgcccgtcaccactccaggctaatttttgtatttttagtagagacggggtttcatcatcttggccagccctggtcttgaactcctgacctcaggtgatccacccgccttggcctcccaaagtgctgggattacaggtgtgagccactgcacctggcccaattttttctatctttaatcccaacctattgccacagtttttgacttctttttcagtgtacttataaaaaacattaaaaggccaggtgcagtggcttatgtgtgattctagtgctttgggaggccaaggtgggaggactgcttgaggccaggagtttgagaccagcctgggcaacatgatgagaccctgtctctacagaaaattaaaaaataaaaattatccaggtgtggtgatacacacttgtggtcctggctatttgggaggctgaggtgggagggttgctggagcccagaagttcgaggttgcagttagctgtgatcgtgccactgcattccagcctgagtgacaaagcgagaccctgtttctaaaaaaaaa

SEQ ID NO: 69072 - DNA, 596 bp, Homo sapiens
gaggccggagacatcctgagagaatacaaactgtcagatgggaatgtcatccacattggggaccaactgtatcaagtgcccgaagttctttttgcccctgaccagctgggaatccacagcccgggactctcaataatggcctccagcaacataatgaactgtgacactgacatccagaagaaagtttttgcagagattgtactgtctgggggcaccactctcttttctgggccagaggaaaggctcatgaaagaactggaacagctagcttccaaagggaacaatcggagaaactggttgttttacggaggctttgactggaatggtgtcctttcctttaaggaatcaaacttaacttacggatccaacaaaagccccttgagaaaactggactcatacttgtctacgcagtctctgaacagagttcctgacctgtgagatctggaacaaaatctacaatatctccaagaatgtataaaacagaattgcagtctgaccacttcaagaccactactctaggctttttgggtttgttttctccctggaccatggtcactcatattggctcagaataaacttctttgaaatactttaca

SEQ ID NO: 69073 - DNA, 227 bp, Homo sapiens
catggtacaacattgatgaaccttgaaaaataggctaagtgaaagaaaccagacaacacaaaatatcacatagtactgggctcccatttatttgaaatgtccaaaataggcaaatttgtagacgaaaagtagatcagtggtttcctgcagctgaagtgtaggttgaaagtggagcatgactgaatgccctttctaaaacaagtaaacctataattcatatttcctta

SEQ ID NO: 69074 - DNA, 542 bp, Homo sapiens
gccaagaaatacaggaaagggtgttcaacctcgccagccatcagagaaatgcaaactccactcctagaacagctgacatgaaaaagaatgaccatagcaactgaacaaatggaagcctcattcgtgcctggtgggaatgtcaattggtttaaccctttgggaaactgtgaggcagtatcctccaacgcagaatataagcagatcctatgagccagcaacgccacctccacgcagacagccaatgggaatgtacaccaagaaatacatgcaagaatgttcacagctgcattactcataatagccccaaactggacctggccacatgcaaatttccatccagaaggaatgaatcaattttggtacatccacacaaaggaatactatacagcaatgcaaaaggtgaactaccgttttgcataccaacacagatgaatcttggacatcatgctgagttaaagcagccaaataccaaagaatgcttgcaaatatttacttattcagaaagtggcaaactaataaataatgctagaagtcaggagaga

SEQ ID NO: 69075 - DNA, 306 bp, Homo sapiens
gtgtaatgatttaaaggaattaataaattgaacagtaacaaaagcagtatttacttggataggctactttaggaaattttagagtcatgatactatgaggaagagaaaaattctttctagtggacattccaaaggaaaaatatcaaaattatcaggagagtatctgcctggatagtgtttcaggttttcttgttggcttttatcagcattctctgatgaaccccagggagccctggttgtgaaggcatcttatttagaaggaaagattgtggccaatttttcttctaacacaggcacttgtctgac

SEQ ID NO: 69076 - DNA, 854 bp, Homo sapiens
  misc_feature (232)..(232): n is a, c, g, or t
tattaacacatttttatgtataccaattttcaacattttaagtcactagaggaatagagcaagtgtccatctcagcataggcacccccttcgtttttgctctgcacctttgtctctgaagctttttctccttttcatttcacctctaccctcccctactctgtggaccaaagcccttgctctgtgcccttgcttgtatggggttgtctttttagtaaattttagaaacaccnaacttgagagtatctcaaagagcatctattccaactcgttgaatatacagatgaaaaaactgaggtctcagaagaagtgatccctcagtgaatgttcaacagggcaaaataaaagaaaggagaaagaattatgggtcagctgaaccacagcttaggataaatactacaggttttgaagtcagccctgtataaaatctcaatgctggcgctaatgtgtatcccttgaacctcagcttttacatcagacataaagacatgacaacatgttcttatagagttattgtaagaatgagaagtcacacaggtaaagcaatgggtgccaaatagattcttttgaaaagataggccaggcgcagtggctcacgactataatccccagcactctgggaggctgaggcaggtggatcacaaggtctggagttcaagactagcctggccaagatggtgaaaccccgtctctactaaaacaaaaattagccgggagcagtggcatgcacctgtgatcccagctactctggaggctgaggcaggagaatagcttgaacccgggtggcggaggttgcagtgagccgagatcgcaccattgcactccagcctgggcgacatagcgagactcagtctc

SEQ ID NO: 69077 - DNA, 246 bp, Homo sapiens
gagagtgtagaagaaaaagcagttgtttatctcttaaggaaacagacaatcttcaggcagggggcagccttttcgctgaaccttgaagtctgtgaagagtttcaaagtaaaggcccctctaggctaaggaaactgtgtgaacaaaaatgaagattatacattttggcaaggggctggggactagagagcacagaagacataggggagtcatagatatggctggacacactggtgagagccctgcat

SEQ ID NO: 69078 - DNA, 1375 bp, Homo sapiens
agcgggctccccggggcccccaatcctcaccatggagggagaggggaacccaggctaaggctcaggagctgggtccaggctccttcttcggggaatctgggcccaggaggtgacctgagggctttgggctgcaggctcggggccaggcttgtatgtcctgccgtccaccgtgggcttcatcaaccacgactgcaccaggtggccagtcccgcctactcgctcgtccggaggcccagtgaggcaccacctcaggacaccagcccgggccccatctacttcttggaccccaaagtcacacgctttggccgcagctgcacccctgcctactccatgcagggccgggccaagtctcggggtccggaggtgacgccaggccctggggcctacagcccagagaaggtgccccctgtgcgccatcggacaccgccggctttcaccctgggctgccgcctccccctgaagcccctggacacctcagcccctgcccctaatgcctacaccatgccccctctgtggggctcacagatcttcaccaagcccagcagccccagctacacggtggtggccgcaccccccccgcccgccccccgcaggatcctgctgagataccaggcccgggccagtacgacagcccggacgcaaacacctaccgccagcgcctgcctgccttcaccatgctggggcggccccgggccccgcgacccctggaggagacccccggccctggcgcccactgcccagagcaggtcaccgtgaacaaagccagggctccagcgttctctatgggcatccgccactcgaaacgggccagcaccatggccgccaccacgccctcccggcctgcggggcacaggctgcccggccgctgctgctaggccaggcctgtttcccacacagtgaacgggggctggcgggcctctcctggggcctggctttggctggaggggctagaaggcgagaggggctgggaaaggagtcttccctcccctttcctgaactgtccaggtccttctaggacacctgatccttccagtccctgggggctgtgacccatggccctgtgcagggtacagggtgagtctccttccagtgccccagtttcttccaggtcacgccaggccaggccaggccaggtggggaaagggacaccttccggccctccccagtagctggctggagatggagcttcttgtgtcccagaactcggcgtccagctccactagggcctggatccccatcacagcttgggttagccccggtcccagcccaaactcaggctggaggcagccccgaggcctgtgcctttcccactccaccttctacagttgcttagccaataaacctttcctgggctggagagctgtcagcatcaaaa

SEQ ID NO: 69079 - DNA, 283 bp, Homo sapiens
ggtttctatttaggctgattttgtgtgtgcagagtgttcgggggtggaattcatctgagagtgagtagatatttctggggctccagatgcacagtcctacatcgttccaggaaagtctgttggtgaaggccccgcctggtgctgggtgcaggggttggggctaggcagagctgacagctgggaggatttgggggctgaggtttaggtgcaggagaaggtgagggtgggaagcccacattgccaagagggaggaaaagggacttagggatgaaatattgagatg

SEQ ID NO: 69080 - DNA, 522 bp, Homo sapiens
gaattcctgaagcacatctctgagtctgtcctcctctggactaaggcagcctagcgtccagggctcagtactcagctgctcagcctctgaggtcatgagggcttctggcatgctgggtgctgcccatcaaccctcccagaatcccctcttcctttcctgacctcatcacttcaaccttctcagggcttcaagatcccacatccctgggcccctcctgtgagcctgctggaaacacactgaaactggaatcctccgacctgctgccgcctctccccggtccctgcaacctcctggctcctccacccttcatcttcatcctgcctgagctgccacagctccgattgtttttggagttgacctagaggactcagaattattagagaccccaggatcctctcctgaggaggaggggcgcccagtctcctcttctacctctgacctggccttgtttctttccccagggcttcgccttgtaagtgcctaggctgaatcttctaaataaatacgatccacacctccaaa

SEQ ID NO: 69081 - DNA, 363 bp, Homo sapiens
gctctaaaacccattttgtgaaatagcaatgtaatttgaatattttaggaactgacctcaatgcttagagcttcctttgtatgttcttaaacgatgccttaacatcgcatttacttatatgttaacatgaaagttataagttgtcttattgtaacgttgacttgtcccttcagagaatcagccttccattatgctcaagtattcatcaaccttcagggctgggatggtataaaataatggcatgagatatacctaatgctagatgacgagttagtgggtgcagcgcaccagcatggcacatgtatacatatgtaactaacctgcacaatgtgcacatgtaccctaaaacttaaagtataatta

SEQ ID NO: 69082 - DNA, 727 bp, Homo sapiens
ggccagttaaaaatacagagactgacccaccaaccaggaggcaccgtgtcttcgggtggcactaactttatgcctgtgacctccaccgtgcccagtggtgcagaaaccgtatgtgaggggatctgggagcatggagagtcactgcaacctgtcccgtgacagctgagatctgggttgggtctcctgaattcaggattctgagtccagtggagtgatggcaggttgccccatcctgccgcatgctttgaggggaccctatcgctgctgccctgcactctcaggacttattcgctggacagagtgggcagaaaagagttccttcatggatcctgtcaccaaatgcataccaaggctccctccatcttaggcactacgctacccatagtgaactacagccatggccctgtcctcatgagagagacagacattggccaggtggacaaataaaataggtaattaaaaatctgtggcactcctgtaatcccagcactttgagatgccgaggtgggtggttcacgaggtcaggagttcaagaccagcctgaccaacaaacccgtctctactaaaaatacaaaattagccggacgtagtagcacttgcctgtaatcccagctactcaggaggctgacgcagaattgcttgaacctgggaggcagagatagcagtgagctgagattgcaccactgcactctagcctgggcaacagagcgagactccatctcaaaaa

SEQ ID NO: 69083 - DNA, 853 bp, Homo sapiens
tggtacattttccaagtgttgaaacaactgtcgactcataattctataagacattcacagatgaaggaaaactaagagaatttgtcataatagaactgctctaaaagaatggccaaaggaagttctcttatcagaaaggaaatggtaaaaggagacctggaacatcaggaaggaagaaagaacaatgggaagagtaaaactctgagtgagtgtagtgggcttttcttcctctgttgacttttgaagaattatgtttgacagttgaggcaaaacgataacattctctgatgtgttaaaaaaaatagctgaaaaaagaaaagaaagaacagtacctgagaaggaaaataaaatctcactgatacaatctttggcacctcctattacctagtaaagcatcagtagaagaaattggtgatggagtatttttattcatctatttggtaaatattgagcacgcactgtatgtcaggtactgttctatccactggagttttagcagtgaacaatagagagggagaaccagacatcattttatcagtaacccagtcctgccataactcactccctcccactataatggcattaatccattcatgagggctgcccccatgacctaatcacctcttaaaggtcccacctctatttgcatgggggttaagtttccaacacatgaaatgtgggggacacagtcaaatcatagcaggtgacttatgggttcttcaataatttgtttttcagaactctaagaggttattaccattgtatcccattgagttttatcccattgtatcccaatgagtgtgtcattgattgattttgctgccttctagttaatgtcataacattgaaaatg

SEQ ID NO: 69084 - DNA, 390 bp, Homo sapiens
aagcttaatgtgaaccaaacaggttgttctcattcatccctccaactacatgtatgtttctttttaaatttgtctttgattttaatgccaccctaacattttcagaaattggttgaatgcacaacttaaatccgcagcttcaatttgattaagaatttgttaacaacaatttagtgggaaatggtagtgtatatcagcaatcaaatggcatctttttctccttctccattaaaaagtatatatttttcgaaatagaagacactaaaaaaatgactcaggcagtaatttgttcataggattttgctgacatttataaactatttgagctttactgctgccttgttgctggcaagaagcgtcagcagtggaagtgttcctggagttaaatgc

SEQ ID NO: 69085 - DNA, 477 bp, Homo sapiens
ctcttctcccaaggcaccggggaacactgtggaattacaaggataacaaacttggtgtctaactctaaagttaattgcatcacaggaacagatgtaagatttcaaatgttacaagatctacaaaagagtcagatgatggcaggattatatgttcttgaggtttaaaatagtgataacccagacttaggttgaaacaaacagcaacccctgtagcttctgtagaggaagtgaggcctgctttgatgggaattctcatttggacatgcaggaaacatgatgagtatttctcctgggcctctacctgtaatagtagcaaccctcagtggaaaaaaaggacacttttgtggaaggggtaacttttcttcctttttgcttctttcctcagggacattccactttcccaggcttttgtatgacctggtatggtttttgtgattatgacaggattttctgttcttatgcactgtgtgtaagttc

SEQ ID NO: 69086 - DNA, 389 bp, Homo sapiens
ggacccaaaatctaattatttagatgctaatcaactgcaggataattcctaaggcatttgaatctgaggacattttcaggaaagtctctgctccttaaatttaggtttttaacctcaaagatacagttactgaaatttaaccattagatgactccagtaacacccacattggcaaaaaacatttggataaacatttgaacatttttgattggttccgaaaatatattatatctaaataaaaaaatatagtcagtagatttttggaggaaaggatggaagaataaaaaaactctttatgtcatacaaagctgtaattcacatttcttttttaaaaagaacaaactaaatgtgtatgttaaatgttaaatcagaacacctgactacttaag

SEQ ID NO: 69087 - DNA, 453 bp, Homo sapiens
ttttgatttattagtagcgacagggtctcactatgttgtgtaagctggtcccaaactttttgccccatgtgattttcccaaagtgttgagattatagatatgagcctctgcactcagccagtattcataaatttaataagacttggtatgtgtcgtaacagaacacactaggagcaagtaagaatattgtgtgtattctcttgcttttgcctggtaagttttgtacatatctgttaagcctagttggtgatatgatatggttggcctaaggttagaggatgtccattttctctaaacctcatgctgcaatataatcctcctgtttgatgtgggacctggtgggtggtgtttgggtcatgggggagcaaattcctcataaatggtttggcaccatccttttgataatcaaaaaggttacgctctattgattcaaatgagagctggttggttaaa

SEQ ID NO: 69088 - DNA, 322 bp, Homo sapiens
ataatggataattaacccttgaacaatggaaagttaactctccatagaaatgccaaaaactgaaatgttttgttattgaatttattctcctttgggagttaacactaatggagaacatctccattagtacaaacctggcaccaaacaacctgttcatccttaagctatgaatgctgcactcaccttccagttcattctggcaggatttgtaacacaaggtgcgctccctcggggtgacgtgcaatggtagcaaaagcgcattgtgagggggaaaatctaataagttggggcgccgtaaattcacgtttgtcaaaatcgaaaa

SEQ ID NO: 69089 - DNA, 1012 bp, Homo sapiens
ggtcgcagctgaccctcgctcccgcccccgcctggagtccgacgtggaagttgctggctgactgggcttgcgaggaaaccgcctcggagctgcagccgaaggccaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaaccta

SEQ ID NO: 69090 - DNA, 797 bp, Homo sapiens
tgcaaaacaaagtattagtagaaaacacctaaaatgttaacagtgatcatatttgggaggtaggattatgagtgaagcttcttttctttatacttctctatataatttctatataatttcataatgtgtaatatattaattataaaatacacgtttaaaatgtatttttggacattttctaaactcgagagagcacattagttaaaagaaattaaatattttcaatttcatttaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggcaagtatcatgcttccagaagccatctgtgcatttgtgtgtgcttgcagctatgcacgtccacgtgtaatttttctcccgtgttgaggatgaaactttgatttacttagcagcttatttcataagttcctcaagcgttttctctcactggtcttcaggtgcatctgtcttctcaaccacacctacctgattacagttacttagataagcaaattctttgccaatttttagccttttccctgcctcacctcaccctccaattccttatccttcaggaattagcttaagactctcttctgaagagcttttcctaatgtatctctattcctactgcctaatcactcacttaaagttagatgcccttgtcacagattagtgacata

SEQ ID NO: 69091 - DNA, 3628 bp, Homo sapiens
  misc_feature (3203)..(3203): n is a, c, g, or t
  misc_feature (3215)..(3215): n is a, c, g, or t
  misc_feature (3229)..(3229): n is a, c, g, or t
  misc_feature (3276)..(3276): n is a, c, g, or t
  misc_feature (3279)..(3279): n is a, c, g, or t
  misc_feature (3283)..(3283): n is a, c, g, or t
  misc_feature (3287)..(3287): n is a, c, g, or t
  misc_feature (3289)..(3290): n is a, c, g, or t
  misc_feature (3293)..(3293): n is a, c, g, or t
  misc_feature (3301)..(3302): n is a, c, g, or t
ggtcgcagctgaccctcgctcccgcccccgcctggagtccgacgtggaagttgctggctgactgggcttgcgaggaaaccgcctcggagctgcagccgaaggccaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaaggtcacctgctagcttgtaaggtaggaatagggctcaaagtaaaacttttggttcagaagcttgactcataaactatactatatattcccaaaaatgtcagtattgacaacacagtctaactcttaaataaaattatgctaattagttacattcaaaataatgtttataaatttatttgtctatactagtagaagtgatcagtgacatactataaataatcctaaatggttatatttgatagaattcataacacattaaagagaaaatttcacattaaaggaaggtttaaaaatctattttcagattataaaaggtgtctttactggttttcattccttttatctacatgtaattggacatgtaaacttgttaaaaatcaaaatcttactgattgtacagggagaaattaagcattctgttttaaaaattaggcttattgctagactgtaagtttaaaaacaattcatgttcaaaggagcttttcaaattacccagtccaccacagaatcagctaatgtgacagaagtaaatatagtgcgtcataattgctaaaaacagggtgaatttctttcacttaagttggaaaaccagcctctaaaaaattaggtgctggtaatgagagcttaataccatggttccctgcaggtctcagaaacattagtagttcctttcttggccctcactgtccttccagtgttggcctctggcctcttcccctcacatttatgttcattctccgggcttatattcattctctgctgctttctcccttcacccgtgggactctcacccttcttgctcattctccagcacccattcctactttagtctctttgaaatcttttttggagattttccttcagctacaaatgttccagtacaaccaatattactcctgaggggcaaagactttttcatatttatgtccctagtatctggtatggcgcctggcatatggcatttcagaatatgttcatagttgaaacagtaggatagatatttgtcatcttgacaagtagccctttgcaatttatacttgagttcactcctggtcaatggcacatggctggaaaatgcagaaagcaagttcacttacagcctgaggcttataaagcttgtacagctgcctcccggcagtccaggaaaactgcaaaaaatgggaagtaaggtcctggcaggcagacccggcatgtagccgctggccatcttgaatcctagggcatgaagttgccccaaagttcagcacttggttaagcctgatccctctggtttatcacaaagaataggatgggataaagaaagtggacacttaaataagctataaattatatggtccttgtctagcaggagacaactgcacaggtatactaccagcgtttggatattgatatatacatggcaaatctgaatattgttttatgagaggcctggcaatgggtaaaacaccaaacttgaaatcagaacataggtgcaaatggccactcctgtagtttcttttctgtaaaatgggatctggacgaatgataccaaacgtttctttctaacattgtattttataactctggcctatgattgtgttgtgtcttgcattaaaaaaaaaaatttgagagtggtagaattacttctgttatctgaaatacctgagatgcactttaaactgttgaaatgtaagctctgagggcagggaccgtatcttatttactgttagtatccgttgcatctagtgtggtgcacctggcacacagtaggcactcaataaatatgtattgattaaaaacaaaagacanaaaaaaaaaaanaaaaaaaaaaaaanaaaaaaaaaaaaaaaaaaaaaaacaaaaaaaaaaaaaaagggggggnggngcgncaanannacnacccccgnngggggccacagataatagccgacccccgcgttttctgtgtaacaaaggaggctgcccaaaaatgaagagcagccgagtaattaataatagagtcacgcacgccggcgcgcaagctatcaacaaacaacggcatgatggcgcagacaaccgcgcgcgacacagacgagcgaaatactgatgggagagaagaaacaccaccacccactcccgggggggggagagaaaacaaacaggggggaagacaaaacacccccacgacagagagaaatagaacaaacagccaacgaggacaaccacactcaaactcaacagagaagtaaaacccc

SEQ ID NO: 69092 - DNA, 3241 bp, Homo sapiens
ctctcgcgttctcctccgtcctctctcggttccccttgattcctgcggggtccagggacccggacagcttggggacgtccgcagagcctgggttcgagttctttacccttatcatgaagttttccctcatccccagctccacttgctgggcagagttgttcttgcggaggctggcaacgcgtcagtcgcaggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaaggtcacctgctagcttgtaaggtaggaatagggctcaaagtaaaacttttggttcagaagcttgactcataaactatactatatattcccaaaaatgtcagtattgacaacacagtctaactcttaaataaaattatgctaattagttacattcaaaataatgtttataaatttatttgtctatactagtagaagtgatcagtgacatactataaataatcctaaatggttatatttgatagaattcataacacattaaagagaaaatttcacattaaaggaaggtttaaaaatctattttcagattataaaaggtgtctttactggttttcattccttttatctacatgtaattggacatgtaaacttgttaaaaatcaaaatcttactgattgtacagggagaaattaagcattctgttttaaaaattaggcttattgctagactgtaagtttaaaaacaattcatgttcaaaggagcttttcaaattacccagtccaccacagaatcagctaatgtgacagaagtaaatatagtgcgtcataattgctaaaaacagggtgaatttctttcacttaagttggaaaaccagcctctaaaaaattaggtgctggtaatgagagcttaataccatggttccctgcaggtctcagaaacattagtagttcctttcttggccctcactgtccttccagtgttggcctctggcctcttcccctcacatttatgttcattctccgggcttatattcattctctgctgctttctcccttcacccgtgggactctcacccttcttgctcattctccagcacccattcctactttagtctctttgaaatcttttttggagattttccttcagctacaaatgttccagtacaaccaatattactcctgaggggcaaagactttttcatatttatgtccctagtatctggtatggcgcctggcatatggcatttcagaatatgttcatagttgaaacagtaggatagatatttgtcatcttgacaagtagccctttgcaatttatacttgagttcactcctggtcaatggcacatggctggaaaatgcagaaagcaagttcacttacagcctgaggcttataaagcttgtacagctgcctcccggcagtccaggaaaactgcaaaaaatgggaagtaaggtcctggcaggcagacccggcatgtagccgctggccatcttgaatcctagggcatgaagttgccccaaagttcagcacttggttaagcctgatccctctggtttatcacaaagaataggatgggataaagaaagtggacacttaaataagctataaattatatggtccttgtctagcaggagacaactgcacaggtatactaccagcgtttggatattgatatatacatggcaaatctgaatattgttttatgagaggcctggcaatgggtaaaacaccaaacttgaaatcagaacataggtgcaaatggccactcctgtagtttcttttctgtaaaatgggatctggacgaatgataccaaacgtttctttctaacattgtattttataactctggcctatgattgtgttgtgtcttgcattaaaaaaaaaaatttgagagtggtagaattacttctgttatctgaaatacctgagatgcactttaaactgttgaaatgtaagctctgagggcagggaccgtatcttatttactgttagtatccgttgcatctagtgtggtgcacctggcacacagtaggcactcaataaatatgtattgattaaaaacaaaagac

SEQ ID NO: 69093 - DNA, 3178 bp, Homo sapiens
ggtcgcagctgaccctcgctcccgcccccgcctggagtccgacgtggaagttgctggctgactgggcttgcgaggaaaccgcctcggagctgcagccgaaggccaaggaatcactgaagatcggcgaggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaaggtcacctgctagcttgtaaggtaggaatagggctcaaagtaaaacttttggttcagaagcttgactcataaactatactatatattcccaaaaatgtcagtattgacaacacagtctaactcttaaataaaattatgctaattagttacattcaaaataatgtttataaatttatttgtctatactagtagaagtgatcagtgacatactataaataatcctaaatggttatatttgatagaattcataacacattaaagagaaaatttcacattaaaggaaggtttaaaaatctattttcagattataaaaggtgtctttactggttttcattccttttatctacatgtaattggacatgtaaacttgttaaaaatcaaaatcttactgattgtacagggagaaattaagcattctgttttaaaaattaggcttattgctagactgtaagtttaaaaacaattcatgttcaaaggagcttttcaaattacccagtccaccacagaatcagctaatgtgacagaagtaaatatagtgcgtcataattgctaaaaacagggtgaatttctttcacttaagttggaaaaccagcctctaaaaaattaggtgctggtaatgagagcttaataccatggttccctgcaggtctcagaaacattagtagttcctttcttggccctcactgtccttccagtgttggcctctggcctcttcccctcacatttatgttcattctccgggcttatattcattctctgctgctttctcccttcacccgtgggactctcacccttcttgctcattctccagcacccattcctactttagtctctttgaaatcttttttggagattttccttcagctacaaatgttccagtacaaccaatattactcctgaggggcaaagactttttcatatttatgtccctagtatctggtatggcgcctggcatatggcatttcagaatatgttcatagttgaaacagtaggatagatatttgtcatcttgacaagtagccctttgcaatttatacttgagttcactcctggtcaatggcacatggctggaaaatgcagaaagcaagttcacttacagcctgaggcttataaagcttgtacagctgcctcccggcagtccaggaaaactgcaaaaaatgggaagtaaggtcctggcaggcagacccggcatgtagccgctggccatcttgaatcctagggcatgaagttgccccaaagttcagcacttggttaagcctgatccctctggtttatcacaaagaataggatgggataaagaaagtggacacttaaataagctataaattatatggtccttgtctagcaggagacaactgcacaggtatactaccagcgtttggatattgatatatacatggcaaatctgaatattgttttatgagaggcctggcaatgggtaaaacaccaaacttgaaatcagaacataggtgcaaatggccactcctgtagtttcttttctgtaaaatgggatctggacgaatgataccaaacgtttctttctaacattgtattttataactctggcctatgattgtgttgtgtcttgcattaaaaaaaaaaatttgagagtggtagaattacttctgttatctgaaatacctgagatgcactttaaactgttgaaatgtaagctctgagggcagggaccgtatcttatttactgttagtatccgttgcatctagtgtggtgcacctggcacacagtaggcactcaataaatatgtattgattaaaaacaaaagac

SEQ ID NO: 69094 - DNA, 2083 bp, Homo sapiens
ggtcgcagctgaccctcgctcccgcccccgcctggagtccgacgtggaagttgctggctgactgggcttgcgaggaaaccgcctcggagctgcagccgaaggccaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaaggtcacctgctagcttgtaaggtaggaatagggctcaaagtaaaacttttggttcagaagcttgactcataaactatactatatattcccaaaaatgtcagtattgacaacacagtctaactcttaaataaaattatgctaattagttacattcaaaataatgtttataaatttatttgtctatactagtagaagtgatcagtgacatactataaataatcctaaatggttatatttgatagaattcataacacattaaagagaaaatttcacattaaaggaaggtttaaaaatctattttcagattataaaaggtgtctttactggttttcattccttttatctacatgtaattggacatgtaaacttgttaaaaatcaaaatcttactgattgtacagggagaaattaagcattctgttttaaaaattaggcttattgctagactgtaagtttaaaaacaattcatgttcaaaggagcttttcaaattacccagtccaccacagaatcagctaatgtgacagaagtaaatatagtgcgtcataattgctaaaaacagggtgaatttctttcacttaagttggaaaaccagcctctaaaaaattaggtgcatttaacgcatggcagccggcagcctattcgcaggacatgcaggcagggggttcttt

SEQ ID NO: 69095 - DNA, 2779 bp, Homo sapiens
ttatgtttaattatttattattaaatagaagttaattttaaaattttttcgtggccttcaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaaggtcacctgctagcttgtaaggtaggaatagggctcaaagtaaaacttttggttcagaagcttgactcataaactatactatatattcccaaaaatgtcagtattgacaacacagtctaactcttaaataaaattatgctaattagttacattcaaaataatgtttataaatttatttgtctatactagtagaagtgatcagtgacatactataaataatcctaaatggttatatttgatagaattcataacacattaaagagaaaatttcacattaaaggaaggtttaaaaatctattttcagattataaaaggtgtctttactggttttcattccttttatctacatgtaattggacatgtaaacttgttaaaaatcaaaatcttactgattgtacagggagaaattaagcattctgttttaaaaattaggcttattgctagactgtaagtttaaaaacaattcatgttcaaaggagcttttcaaattacccagtccaccacagaatcagctaatgtgacagaagtaaatatagtgcgtcataattgctaaaaacagggtgaatttctttcacttaagttggaaaaccagcctctaaaaaattaggtgctggtaatgagagcttaataccatggttccctgcaggtctcagaaacattagtagttcctttcttggccctcactgtccttccagtgttggcctctggcctcttcccctcacatttatgttcattctccgggcttatattcattctctgctgctttctcccttcacccgtgggactctcacccttcttgctcattctccagcacccattcctactttagtctctttgaaatcttttttggagattttccttcagctacaaatgttccagtacaaccaatattactcctgaggggcaaagactttttcatatttatgtccctagtatctggtatggcgcctggcatatggcatttcagaatatgttcatagttgaaacagtaggatagatatttgtcatcttgacaagtagccctttgcaatttatacttgagttcactcctggtcaatggcacatggctggaaaatgcagaaagcaagttcacttacagcctgaggcttataaagcttgtacagctgcctcccggcagtccaggaaaactgcaaaaaatgggaagtaaggtcctggcaggcagacccggcatgtagccgctggccatcttgaatcctagggcatgaagttgccccaaagttcagcacttggttaagcctgatccctctggtttatcacaaagaataggatgggataaagaaagtggacacttaaataagctataaattatatggtccttgtctagcaggagacaactgcacaggtatactaccagcgtttggatattgatatatacatggcaaatctgaatattgttttatgagaggcctggcaatgggtaaaacaccaaacttgaaatcagaacataggtgcaaatggccactcctgtagtttcttttctgtaaaatgggatctggacgaatgataccaaacgtttctttctaacattgtattttataactctggcctatgattgtgttgtgtcttgcattaaaaaaaaaaatttgagagtggtagaattacttctgttatctgaaatacctgagatgcactttaaactgttgaaatgtaagctctgagggcagggaccgtatcttatttactgttagtatccgttgcatctagtgtggtgcacctggcacacagtaggcactcaataaatatgtattgattaaaaacaaaagac

SEQ ID NO: 69096 - DNA, 1222 bp, Homo sapiens
ggtcgcagctgaccctcgctcccgcccccgcctggagtccgacgtggaagttgctggctgactgggcttgcgaggaaaccgcctcggagctgcagccgaaggccaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctaaaaaaaaaatggccacaggagatggggagaggagtctgaactaaacccctggcttttgtgcacactgcatacgttccagaactcctggatggtaaccatctttggaatgcagcgcttgctgcaatggtgatcaggattacttgccgtggtttttttgccctcgaaggttcttggcacacttctttaccctactggaccggccggtgccct

SEQ ID NO: 69097 - DNA, 737 bp, Homo sapiens
ggtcgcagctgaccctcgctcccgcccccgcctggagtccgacgtggaagttgctggctgactgggcttgcgaggaaaccgcctcggagctgcagccgaaggccaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgtaacattataaaagcatacgcccgttattacgggcgtactgcggatgaatttttgcacactgatcag

SEQ ID NO: 69098 - DNA, 489 bp, Homo sapiens
  misc_feature (23)..(24): n is a, c, g, or t
gcggcgcctactactactaaatnngcggccgctcgactccttgtctagcaggagacaactgcacaggtatactaccagcgtttggatattgatatatacatggcaaatctgaatattgttttatgagaggcctggcaatgggtaaaacaccaaacttgaaatcagaacataggtgcaaatggccactcctgtagtttcttttctgtaaaatgggatctggacgaatgataccaaacgtttctttctaacattgtattttataactctggcctatgattgtgttgtgtcttgcattaaaaaaaaaaatttgagagtggtagaattacttctgttatctgaaatacctgagatgcactttaaactgttgaaatgtaagctctgagggcagggaccgtatcttatttactgttagtatccgttgcatctagtgtggtgcacctggcacacagtaggcactcaataaatatgtattgattaaaaacaaaagac

SEQ ID NO: 69099 - DNA, 3201 bp, Homo sapiens
ggtcgcagctgaccctcgctcccgcccccgcctggagtccgacgtggaagttgctggctgactgggcttgcgaggaaaccgcctcggagctgcagccgaaggccaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaaggtcacctgctagcttgtaaggtaggaatagggctcaaagtaaaacttttggttcagaagcttgactcataaactatactatatattcccaaaaatgtcagtattgacaacacagtctaactcttaaataaaattatgctaattagttacattcaaaataatgtttataaatttatttgtctatactagtagaagtgatcagtgacatactataaataatcctaaatggttatatttgatagaattcataacacattaaagagaaaatttcacattaaaggaaggtttaaaaatctattttcagattataaaaggtgtctttactggttttcattccttttatctacatgtaattggacatgtaaacttgttaaaaatcaaaatcttactgattgtacagggagaaattaagcattctgttttaaaaattaggcttattgctagactgtaagtttaaaaacaattcatgttcaaaggagcttttcaaattacccagtccaccacagaatcagctaatgtgacagaagtaaatatagtgcgtcataattgctaaaaacagggtgaatttctttcacttaagttggaaaaccagcctctaaaaaattaggtgctggtaatgagagcttaataccatggttccctgcaggtctcagaaacattagtagttcctttcttggccctcactgtccttccagtgttggcctctggcctcttcccctcacatttatgttcattctccgggcttatattcattctctgctgctttctcccttcacccgtgggactctcacccttcttgctcattctccagcacccattcctactttagtctctttgaaatcttttttggagattttccttcagctacaaatgttccagtacaaccaatattactcctgaggggcaaagactttttcatatttatgtccctagtatctggtatggcgcctggcatatggcatttcagaatatgttcatagttgaaacagtaggatagatatttgtcatcttgacaagtagccctttgcaatttatacttgagttcactcctggtcaatggcacatggctggaaaatgcagaaagcaagttcacttacagcctgaggcttataaagcttgtacagctgcctcccggcagtccaggaaaactgcaaaaaatgggaagtaaggtcctggcaggcagacccggcatgtagccgctggccatcttgaatcctagggcatgaagttgccccaaagttcagcacttggttaagcctgatccctctggtttatcacaaagaataggatgggataaagaaagtggacacttaaataagctataaattatatggtccttgtctagcaggagacaactgcacaggtatactaccagcgtttggatattgatatatacatggcaaatctgaatattgttttatgagaggcctggcaatgggtaaaacaccaaacttgaaatcagaacataggtgcaaatggccactcctgtagtttcttttctgtaaaatgggatctggacgaatgataccaaacgtttctttctaacattgtattttataactctggcctatgattgtgttgtgtcttgcattaaaaaaaaaaatttgagagtggtagaattacttctgttatctgaaatacctgagatgcactttaaactgttgaaatgtaagctctgagggcagggaccgtatcttatttactgttagtatccgttgcatctagtgtggtgcacctggcacacagtaggcactcaataaatatgtattgattaaaaacaaaagac

SEQ ID NO: 69100 - DNA, 3230 bp, Homo sapiens
ggtcgcagctgaccctcgctcccgcccccgcctggagtccgacgtggaagttgctggctgactgggcttgcgaggaaaccgcctcggagctgcagccgaaggccaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaaggtcacctgctagcttgtaaggtaggaatagggctcaaagtaaaacttttggttcagaagcttgactcataaactatactatatattcccaaaaatgtcagtattgacaacacagtctaactcttaaataaaattatgctaattagttacattcaaaataatgtttataaatttatttgtctatactagtagaagtgatcagtgacatactataaataatcctaaatggttatatttgatagaattcataacacattaaagagaaaatttcacattaaaggaaggtttaaaaatctattttcagattataaaaggtgtctttactggttttcattccttttatctacatgtaattggacatgtaaacttgttaaaaatcaaaatcttactgattgtacagggagaaattaagcattctgttttaaaaattaggcttattgctagactgtaagtttaaaaacaattcatgttcaaaggagcttttcaaattacccagtccaccacagaatcagctaatgtgacagaagtaaatatagtgcgtcataattgctaaaaacagggtgaatttctttcacttaagttggaaaaccagcctctaaaaaattaggtgctggtaatgagagcttaataccatggttccctgcaggtctcagaaacattagtagttcctttcttggccctcactgtccttccagtgttggcctctggcctcttcccctcacatttatgttcattctccgggcttatattcattctctgctgctttctcccttcacccgtgggactctcacccttcttgctcattctccagcacccattcctactttagtctctttgaaatcttttttggagattttccttcagctacaaatgttccagtacaaccaatattactcctgaggggcaaagactttttcatatttatgtccctagtatctggtatggcgcctggcatatggcatttcagaatatgttcatagttgaaacagtaggatagatatttgtcatcttgacaagtagccctttgcaatttatacttgagttcactcctggtcaatggcacatggctggaaaatgcagaaagcaagttcacttacagcctgaggcttataaagcttgtacagctgcctcccggcagtccaggaaaactgcaaaaaatgggaagtaaggtcctggcaggcagacccggcatgtagccgctggccatcttgaatcctagggcatgaagttgccccaaagttcagcacttggttaagcctgatccctctggtttatcacaaagaataggatgggataaagaaagtggacacttaaataagctataaattatatggtccttgtctagcaggagacaactgcacaggtatactaccagcgtttggatattgatatatacatggcaaatctgaatattgttttatgagaggcctggcaatgggtaaaacaccaaacttgaaatcagaacataggtgcaaatggccactcctgtagtttcttttctgtaaaatgggatctggacgaatgataccaaacgtttctttctaacattgtattttataactctggcctatgattgtgttgtgtcttgcattaaaaaaaaaaatttgagagtggtagaattacttctgttatctgaaatacctgagatgcactttaaactgttgaaatgtaagctctgagggcagggaccgtatcttatttactgttagtatccgttgcatctagtgtggtgcacctggcacacagtaggcactcaataaatatgtattgattaaaaacaaaagacgtcttcaatatgccagatatatttgtcct

SEQ ID NO: 69101 - DNA, 3115 bp, Homo sapiens
ctagaggatcccctctctcacactggactgaagatcggcgagggaggacaggcggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaaggtcacctgctagcttgtaaggtaggaatagggctcaaagtaaaacttttggttcagaagcttgactcataaactatactatatattcccaaaaatgtcagtattgacaacacagtctaactcttaaataaaattatgctaattagttacattcaaaataatgtttataaatttatttgtctatactagtagaagtgatcagtgacatactataaataatcctaaatggttatatttgatagaattcataacacattaaagagaaaatttcacattaaaggaaggtttaaaaatctattttcagattataaaaggtgtctttactggttttcattccttttatctacatgtaattggacatgtaaacttgttaaaaatcaaaatcttactgattgtacagggagaaattaagcattctgttttaaaaattaggcttattgctagactgtaagtttaaaaacaattcatgttcaaaggagcttttcaaattacccagtccaccacagaatcagctaatgtgacagaagtaaatatagtgcgtcataattgctaaaaacagggtgaatttctttcacttaagttggaaaaccagcctctaaaaaattaggtgctggtaatgagagcttaataccatggttccctgcaggtctcagaaacattagtagttcctttcttggccctcactgtccttccagtgttggcctctggcctcttcccctcacatttatgttcattctccgggcttatattcattctctgctgctttctcccttcacccgtgggactctcacccttcttgctcattctccagcacccattcctactttagtctctttgaaatcttttttggagattttccttcagctacaaatgttccagtacaaccaatattactcctgaggggcaaagactttttcatatttatgtccctagtatctggtatggcgcctggcatatggcatttcagaatatgttcatagttgaaacagtaggatagatatttgtcatcttgacaagtagccctttgcaatttatacttgagttcactcctggtcaatggcacatggctggaaaatgcagaaagcaagttcacttacagcctgaggcttataaagcttgtacagctgcctcccggcagtccaggaaaactgcaaaaaatgggaagtaaggtcctggcaggcagacccggcatgtagccgctggccatcttgaatcctagggcatgaagttgccccaaagttcagcacttggttaagcctgatccctctggtttatcacaaagaataggatgggataaagaaagtggacacttaaataagctataaattatatggtccttgtctagcaggagacaactgcacaggtatactaccagcgtttggatattgatatatacatggcaaatctgaatattgttttatgagaggcctggcaatgggtaaaacaccaaacttgaaatcagaacataggtgcaaatggccactcctgtagtttcttttctgtaaaatgggatctggacgaatgataccaaacgtttctttctaacattgtattttataactctggcctatgattgtgttgtgtcttgcattaaaaaaaaaaatttgagagtggtagaattacttctgttatctgaaatacctgagatgcactttaaactgttgaaatgtaagctctgagggcagggaccgtatcttatttactgttagtatccgttgcatctagtgtggtgcacctggcacacagtaggcactcaataaatatgtattgattaaaaacaaaagac

SEQ ID NO: 69102 - DNA, 2981 bp, Homo sapiens
ggtcgcagctgaccctcgctcccgcccccgcctggagtccgacgtggaagttgctggctgactgggcttgcgaggaaaccgcctcggagctgcagccgaaggccaaggaatcactgaagatcggcgagggaggacagggggttcatcatgggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggttagttgaaacattaaaaagcagacagtaattcagtccattcttctcccctgaaatgaagactacatcacctctctccctttggaaacagtcaagtgtacttcacactactagatgttaaaactatatgattattggcatatactgactgactgcaatatttgtagtaaatagggaaaataagtatttagttggagggataatttgatcgaatcacctgaatgttctatgtaatgtaaaatattcttttcttgctttcttgtgttaaggtatatattctatttgtatggaattcttattcaaatacagttctattaaagagtatactcctattggatgaaaaaaacctatttttgaatagtagttgcagcttgtttgtataaatactaaaaaatatcttaacagatttttttccccttaaaatgaattatctttccaaagattagactcagtatgagagtaggtgaggaacatagtttgtgtaatataatctttatttgcttacctgaccactttttattaagctgttttgtttaaaagcttttggttataggcatgaatattgttttgatggttaacttcactgacttatctgtaagtgtcattttatagtactttacagttgtcaaaaaaaatcttacatatattgatctagttgatcggtagaggaagcttgtgaagtaggtaggacaggttatgatgtcttcactgtatggacgtgaacccagggttctaataggttggcttgcccaaggtcacctgctagcttgtaaggtaggaatagggctcaaagtaaaacttttggttcagaagcttgactcataaactatactatatattcccaaaaatgtcagtattgacaacacagtctaactcttaaataaaattatgctaattagttacattcaaaataatgtttataaatttatttgtctatactagtagaagtgatcagtgacatactataaataatcctaaatggttatatttgatagaattcataacacattaaagagaaaatttcacattaaaggaaggtttaaaaatctattttcagattataaaaggtgtctttactggttttcattccttttatctacatgtaattggacatgtaaacttgttaaaaatcaaaatcttactgattgtacagggagaaattaagcattctgttttaaaaattaggcttattgctagactgtaagtttaaaaacaattcatgttcaaaggagcttttcaaattacccagtccaccacagaatcagctaatgtgacagaagtaaatatagtgcgtcataattgctaaaaacagggtgaatttctttcacttaagttggaaaaccagcctctaaaaaattaggtgctggtaatgagagcttaataccatggttccctgcaggtctcagaaacattagtagttcctttcttggccctcactgtccttccagtgttggcctctggcctcttcccctcacatttatgttcattctccgggcttatattcattctctgctgctttctcccttcacccgtgggactctcacccttcttgctcattctccagcacccattcctactttagtctctttgaaatcttttttggagattttccttcagctacaaatgttccagtacaaccaatattactcctgaggggcaaagactttttcatatttatgtccctagtatctggtatggcgcctggcatatggcatttcagaatatgttcatagttgaaacagtaggatagatatttgtcatcttgacaagtagccctttgcaatttatacttgagttcactcctggtcaatggcacatggctggaaaatgcagaaagcaagttcacttacagcctgaggcttataaagcttgtacagctgcctcccggcagtccaggaaaactgcaaaaaatgggaagtaaggtcctggcaggcagacccggcatgtagccgctggccatcttgaatcctagggcatgaagttgccccaaagttcagcacttggttaagcctgatccctctggtttatcacaaagaataggatgggataaagaaagtggacacttaaataagctataaattatatggtccttgtctagcaggagacaactgcacaggtatactaccagcgtttggatattgatatatacatggcaaatctgaatattgttttatgagaggcctggcaatgggtaaaacaccaaacttgaaatcagaacataggtgcaaatggccactcctgtagtttcttttctgtaaaatgggatctggacgaatgataccaaacgtttctttctaacattgtattttataactctggcctatgattgtgttgtgtcttgcattaaaaaaaaaaatttgagagtggtagaattacttctgttatctgaaatacctgagatgcactttaaactgttgaaatgtaagctctgagggcagggaccgtatcttatttactgttagtatccgttgcatctagtgtggtgcacctggcacacagtaggcactcaataaatatgtattgattaaaaacaaaagac

SEQ ID NO: 69103 - DNA, 1045 bp, Homo sapiens
ggtcgcagctgaccctcgctcccgcccccgcctggagtccgacgtggaagttgctggctgactgggcttgcgaggaaaccgcctcggagctgcagccgaaggccaaggaatcactgaagatcggcgagggaggacagggggttcatcatgggtggctttttctcaagtatattttccagtctgtttggaactcgggaaatgagaattttaattttgggattagatggagcaggaaaaaccacaattttgtacagattacaagtgggagaagttgttactactatacctaccattggatttaatgtagagacggtgacgtacaaaaaccttaaattccaagtctgggatttaggaggacagacaagtatcaggccatactggagatgttactattcaaacacagatgcagtcatttatgtagtagacagttgtgaccgagaccgaattggcatttccaaatcagagttagttgccatgttggaggaagaagagctgagaaaagccattttagtggtgtttgcaaataaacaggacatggaacaggccatgacttcctcagagatggcaaattcacttgggttacctgccttgaaggaccgaaaatggcagatattcaaaacgtcagcaaccaaaggcaccggccttgatgaggcaatggaatggcaagtatcatgcttccagaagccatctgtgcatttgtgtgtgcttgcagctatgcacgtccacgtgtaatttttctcccgtgttgaggatgaaactttgatttacttagcagcttatttcataagttcctcaagcgttttctctcactggtcttcaggtgcatctgtcttctcaaccacacctacctgattacagttacttagataagcaaattctttgccaatttttagccttttccctgcctcacctcaccctccaattccttatccttcaggaattagcttaagactctcttctgaagagcttttcctaatgtatctctattcctactgcctaatcactcacttaaagttagatgcccttgtcacagattagtgacata

SEQ ID NO: 69104 - DNA, 701 bp, Homo sapiens
cgcgcagaggccggcgcgcctggagctggcgggttggcagcggccgggcggggaggccgaaagtttctctgcccgcctcggccagtgagtgggagccgggagctgcatcccgcgcagtgggaccggcccggcccgctcagcagctctggaaaaagagagacgggaacacaccgggaaacactgggaaaaaaaaaaagtctcaagtgcgcccgaggcgcagggggcaggtctgcggctctcgcgggctctgtgacgggcttggctatgacctcagtcccctcgcgagccacgacgtgccccttgctgccacagcctttccaagactcctgcccgtgccctgtccgcgatcttcaggccccggagtcaccatggggcaggcgtcagatagcctcatctcgcggccacaggttccactagtgaggcacctgcgcggtgcttcgcagtacaggctgcgtcgtgtcctctcatatctcatggaagcgtcaaccggtatgtccgacggcgctgctggaggtctggcgttcgtcccaggacctccggtcagaggcaacgtccaagttccagaatagtggcgcacagacgcgaccgagccttcgttctacagtcaacggtcactgcctatgcacagcccaggggctcaccatcaggccgagattacgcgggcactggtccagcaggggattcagcggggccaggctggg

SEQ ID NO: 69105 - DNA, 427 bp, Homo sapiens
ctgcatggagggtggaatttataagccttgataaagacacttagttgaaactctaggggcagagataacacccttagcagaaagggcgggggtctctcaggatttctgcttcgatgtgctctttccttctcaccttgttcctttttcctcatttgccctccagccccaattatcaatcatggagggtgcccctggatgctccttctgggctgtggggtggcatgggctgcgcaggcctggatttgagaagcactccgaccaaggcacctccctcaccctcacccagggaagtgactcaggagttgaggaagactgagctctacacccctcacgatgcagaggccttgtatccaactctatagtcataatttttatttattttccttggagatagtgccaatatttatgtaagcattagtccccatgg

SEQ ID NO: 69106 - DNA, 2125 bp, Homo sapiens
  misc_feature (922)..(922): n is a, c, g, or t
  misc_feature (1159)..(1159): n is a, c, g, or t
  misc_feature (1296)..(1296): n is a, c, g, or t
  misc_feature (1863)..(1863): n is a, c, g, or t
gacagtgggacccgcgacctgccgtggtctcaggcactggaggacacctgcaacgccgtgcgctagactatgctactgaaggacctctaccgcggctcagccctggactaaggcaccggaggatccccgccctgccccgccccgcggtgtcctggactgtgcactgcagaacccccacccttccacaccctggactctggctcccgaggaccttggccccggctcgccctgaactactcctgcccctcagcgccctggactgtggttccagaggacctggtcctggggcaacttgtgctaccgcgtggactccaggaccccagtccttccacgccctagaccaaggcacgggagaacctctgactcgccgcccccgacctagggcaccagaggacccacaccttgccgtgccccggactacagcacggaaggacccccgatccgccgggcactgggctcctgcacagagggacccccgccatggaggtctggactacccctgccccaccgcaccctggactactgcacgccaagaccctcgcctgaacacgccctacactctggcatgggggaacccggccccgcagagccctggactctggcattggaggactcctcggctaggttctggactcctgcaccagaggactcctgccctgccacaccctggacacctgcactagagaaccctgccccgtcgccccctagactatggcacgggaggacccctgccaccgacttcggcacggtaagacccctgacccgccttgcactggattccagcactggaggaccccctgccacggcgctctctggactacccctgcgccaccgcgtcctgcactacagcacagcaggaccgccgtcccaccgcgcactggactgaggcacagcagcacccgggcctcgtggttggtggacngcaggacgaggtgaccccccgccccgctgcgcgttggactatggcacaggaggaccaccattcccgcatgccctggaccactgcaggacaggtcccccactccgcagcggcctggaatatggcactgcaggacccccgccctgctgctccacggactccaccactgaagaccctcgcccccctgcaccctggacaaaggcacgggaggacccggcttcaccgcccagtgggctatcncataggaaaacccccagcccacccccatcgcgccagagactctgacaagagagaacccctgccccctgctccccggactacagcaaggcaggaaccaccctcctccaggatcctcactatggcaactgtggaacccngccctggtacgccctggactaagtcaccgaaggaccccgaccccaccacaccgtgaactccagcactggaggaccattgccttactgcggactcaagcactggactatcgcagggctggatccctgtcccgccatgccctacactatggcacgggaggacccagcctcactgagctctggactccagcaccggaggacacctacacggaggactcctgctccgccacgtcctggactcctgcacaagagaacccccgccccgcggcaccctggatatagcaaggcaggaatcccgccctgcagtgttctggactgcggcacctgagaatccatgccccatcgcgccctggactgctgctccacaggactcctgttccactgcaccctggactatggcaccagaggacccagccccctggcgtcttggactaaggcacagtaggaccccgcagcatcgtgtactcctgcacaggaggaccctcgcagggctgcgtcctggactgagctactgaaggagcctcacccctgcctcaccctggtctaaggcactggagaactcttgctccncagagctgcggactcttgcacgagagaacctgcgcccagccgtgccctggactgtggcacagtagggcccacaccgggccatggactcctgtactggaggaagagtggtgataaatgtccaggtttacaagttgaaaagtagcagtcaatgtgctacaatggatggatttgatgtaaaattacaaatgctgaaaacattatgtgtaattgcctagccagatcaattacacaagacaaagaaataaaagaaatccatataggg

SEQ ID NO: 69107 - DNA, 538 bp, Homo sapiens
ttaaaatgtattttgtctaaccggaatatgatcacttcaatttgtgtttttttagacagggtctggactttgttgtctacgctgcagtgcagtggttacgatcacggctcagtgcagcctcaacctccaggctgcctccagtgcagcctcatcctcctacctcacctcagcctcccgaagtgctgggattataggcatgagccaccgtgcctggcctaagatttgtaacattaatagttatccaggaaaatgcaaacaacagtaagataccactttatatccactagcatggctagagtcaaaagacagacattaacaagcatttgccaggatgtggagaaaccctcatcaccctactggtgggatcaaatgataaagccacgttgaaaaacagtctagtatttccccagatggttaaacttagcattacttcatgatccagcaatgccagccctacatataaacccaaaagaagtgaaaacatgtccacactaaaatttatacacacacgtttcaagctcggtaacctctggcacga

SEQ ID NO: 69108 - DNA, 1380 bp, Homo sapiens
attctgggactgcagtctaaatctgagttggcaaataccatgtttatctgttgtttgataaaatactgacaaaatcttataaaaactggattacttgaataactgctttgagaaaatagaatgtagtgaatacttctctcttttctgcttcagcaattaaatgacttgcatatgtgatttctaagaaagagcttgttggttcactcttttaaaaaacaaaaataaaaacatttcattgttttaaaatgaatactagaggtcaggcacagtggctcgcacctgtaatctcagcctcccgaagtgctgggattataggcatgagccaccgtgcctggcctaagatttgtaacattaatagttatccaggaaaatgcaaacaacagtaagataccactttatatccactagcatggctagagtcaaaagacagacattaacaagcatttgccaggatgtggagaaaccctcatcaccctactggtgggatcaaatgataaagccacgttgaaaaacagtctagtatttccccagatggttaaacttagcattacttcatgatccagcaatgccagccctacatataaacccaaaagaagtgaaaacatgtccacactaaaatttatacacacacgtttatagcaatattattcataatagccaagaaatagaaacaacctaaatgactcccaactgacaaatggataaacattctaatgtatatccatacaatagaatgttatttggccattaaaaaaatgaaatactgatacatgttacaacatagatgaatcttgaaaatattatgcaaagtgagagaagttagtcataaaagaccatgtattatattgtttcatatgtgttaaatgtctggaataggcaaatctttatagacagaaagtagaatagtgattgtcaagactgcagggaatagggggctggagaacaataggtaaatggtacatggtttcttttggaggtgataaaatattctaaatttgactgtggtgatggttgcatgtactatgaatatactgtaagccactgaatttcagacttgaaatgagtgaattgtgtggttctaaaaaaaaaaaaaaaagaaaagaaaaaaaaagttgtgtgccaaaaggtctttgtcacctgagctatatgtcaataaagttttaccaaaaaaagaaattatgaaaagaataagcagatttttgcaagagtatttaccaattggagtgcctctaagccaaaaattccaattgtcttatataaagacgtatatgataccccaaaccattgtattgtatactttaaaatggtgcagatagtaaattttatgtaatgttttacctcaatttttataaaaatctatttgcttaaaaacgttaatat

SEQ ID NO: 69109 - DNA, 623 bp, Homo sapiens
cgcctcagcctcccagagtgctgggattacaggcatgagccaccatgcctggccaaaagttttgactcttaatgaagcccactttatccattttttctttcgtcacctgtgctttcggtgtctcttctctttttttgtgcttgctctttaattcatcttcatctaccttttttttgttttaaacacatagaaggttacacaaacatatcttcctactcagccttggtttataatttactgttgccctaagaatttcagaaaggaaaagaattcttgcttccctggctaggctcttggggtcttgatgtgcaagaagaaatgctgttgtgaatacaaagaatgatgaggaagtatacaaaaggtgccctaggctggctgcgggggtccagcaggctggctacattattctgtggtcaacctcttacaaatggggtgctcctgtccgtctccgtggccagctgccaccagccctatggtgtgaatggcaaggaagtggggactggcggctggccgaactccaggatgcagccttggctggcagagaaccaaaggcagagggggaaaaacactcttgagtatgagagaaataatgctagctccgaaacctataattcgcaagttta

SEQ ID NO: 69110 - DNA, 505 bp, Homo sapiens
agagggctcctgagggcaaccctgagggttacccaggccccagcaccacctgggaggacatccctggtctccaagcctccctcttccctgcttagcatcaaagacctaaaggggttaggaaagttcttaaaagtgatgagcattttaactgttaggctgtggaccaccccgtgtctctggaggcactttttccagtcttcccttcatagcagccaactctacaatcccacaagacctggtcttttagggctgaccgtttgagattcttatagttagtttttatatttacagagagaggccatttataaggaaggcctttaactgttttgagaggggcatttgactctcccataaatcctgctcatttctgtctccctgctggtacccaaaaatacccggaagtagcccccagaccttaaatagttgaaaagggtgtcaggggtgggggaaggattgtgtgtgtgtgaagtgtgtaaaggaataaaccaaccctttgacagaaaaa

SEQ ID NO: 69111 - DNA, 428 bp, Homo sapiens
ttgccctttccctcgattcctctgcaggactgggctttattaatctccatttccttgagcttggctatagtaggtgttcaataaacatttgttttgttgtgtgctttgtaaataggcaatgaagctgatttcacaagataggcacaaaagttagtttcattacaacacattaccaacagctgtatttttaacttttaacatatctcattctaaatcctgtggcagcacaacctccttccgtcatacctggagataaattttctttcaaaatctaatatgcactgtatttatagaatatgaaacataccgaccatgttttgcaaaaatgggaaaggcataacttagctttggggcatgtaagtaacaactcctgataggagaagaaatgtattcagaaagctcaaattagaaataaaatgggagactct

SEQ ID NO: 69112 - DNA, 3120 bp, Homo sapiens
  misc_feature (828)..(828): n is a, c, g, or t
aggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccggntgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcggctacagggggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctggtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcgtccttcatctgggcagaccccccaccctgcagatgcttctaataaaaagctcttctcatcc

SEQ ID NO: 69113 - DNA, 2985 bp, Homo sapiens
  misc_feature (828)..(828): n is a, c, g, or t
aggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccggntgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcagggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccatgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcgtccttcatctgggcagaccccccaccctgcagatgcttctaataaaaagctcttctcatcc

SEQ ID NO: 69114 - DNA, 2937 bp, Homo sapiens
  misc_feature (828)..(828): n is a, c, g, or t
aggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccggntgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcagggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctggtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcagagccctgggccatggtgcctttggggaggtgtatgagggactggtaattggccttcctggggactccagtcccctgcaggtagctatcaagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcgtccttcatctgggcagaccccccaccctgcagatgcttctaataaaaagctcttctcatcc

SEQ ID NO: 69115 - DNA, 452 bp, Homo sapiens
tgttacccgctggccaatggagctttgtggtctgtttccgtctgccctctgcctgaactctcatccggcttgtactgcctgctggacccctccacctggaggccagcccatgtctcaggcccagcctagcctcttctcctcaaattctaagtgttttctctttaggtttccctggctttgtgaatggatcatgtgtctctaggtataaacctgacatcatctttccacccggcttacctccagcagatctccccagttctgtctccatcttctacctgcatggacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccagtgagctgggatgggtttctgcggg

SEQ ID NO: 69116 - DNA, 2730 bp, Homo sapiens
  misc_feature (828)..(828): n is a, c, g, or t
aggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggaggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccggntgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcagggggcgacgcttcagagactgacaacctctgggctgatggggaagatggagtatccttcatacaccccagcagcgagctcttcctgcagcctctggcagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatggacctgcacaagcccccaggccctctggttctgatggtggctgtggtggcaacctcaacactgagcctccttatggtgtgtggggtcctgattctgggtggggcttggcccggcccagtcctggcctctgccaccaggtgtcaccgaggtttccccagccaatgttactctgctcagaccctgccagaactctgctcgcctcaggatgagctggatttcctcatggaggccctcatcatcagcaagtttcgccatcagaacattgtgcggtgtgtggggctcagcctcagggccacccctcgcctcattctgctggaactgatgtctggaggggacatgaagagtttcctgaggcacagtcggccacacctgggccagccatcacctctggtcatgcgggacctgctgcaactggcccaggacatagcccagggctgccactacctggaggaaaatcacttcatccacagggatattgccgcccggaactgcctgctgagctgcgctggacccagccgagtggccaagattggggactttgggatggcacgagatatctaccgggccagttattaccgcaggggggaccgggccttgctcccagtcaagtggatgcccccagaggccttcctggagggcatcttcacatccaagacagattcctggtcttttggggtgctgctctgggagatcttctcactgggctacatgccctatcctgggcgcaccaaccaggaggtgctggacttcgtcgttggaggaggccggatggaccctcctaggggctgcccagggcctgtgtaccgcatcatgacccagtgttggcagcacgagcctgagctccgccctagctttgccagcatcttggagcgtctgcagtactgcactcaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcgtccttcatctgggcagaccccccaccctgcagatgcttctaataaaaagctcttctcatcc

SEQ ID NO: 69117 - DNA, 538 bp, Homo sapiens
ttttcaaaattagaaaataaacacattaatgtaaatatgttgagacagacaaagaaatttgtctgctacttaataaacacgcgatttatactttttgtcttctaattaattgtcgaccctgaataaggtggtacaactaaggcatattatggaaaactggcattattgcttaatgtaacatgagggattggaatttctttaaagtaattttaagatatgattatttagcagaaatattcactggagcattttacttttagaaattatcgtcacacaaggaagcctttataggaccgactacctaattgcagtcaaagatctcttgaatgaatgaacacacacacacagaagaacacacattttaagaatatagtggtcctatatttttaaaaatttttgccacattttttatatctgaacagaacgtatgtgtctaagcagatgttttaagttatatccttcatgtaggtgagtctgtaaatgtaccatttaacttaaatggctttgtgggaaggtagtttgaggagtttaaaaagga

SEQ ID NO: 69118 - DNA, 434 bp, Homo sapiens
aaacacacacactctccctggaaagctccttctcacccctggatctcagcttacatggctcctcctcagacctcagagacacctttcctgaccaccccatctaaagaaggctgccgtctcaaaaaaaaaaaaaaaaaaaaaggaagaagaagaaggctgccccaggctttctattctctgtctcagccccttgtttctttcctagcttctattataacttccaattattttgtctagttcttgttctctctcctgtctctcctatcccttcccatacaaatgcttcatgagggcaagggtcatgcctgcttattctcaatagtctcctcagtgcctggccacagcagatactcaaaaaatatttgttggatgaatgaatgaattagcaaatgaatgaatgaatgaatgaatgaatgaatgaatgaatggactgg

SEQ ID NO: 69119 - DNA, 800 bp, Homo sapiens
aaggggtgccaacagcacaagaaaaggagagagagagggggtgggtttggctggagcgtcaggggttgagagctgaggccaagtgtggttggaccagatgaggtgatgatgccgtctctcccccacaccctagggactcgtacacatgcatacgcatacttacacatacccacacttgcatcactctattccctccacagtcccaagctccccatcatttagaagagacctgtcccattatagcattgggacactgctgagggttttcttcccagactcggagctgcttccccctaacagaaccaaatcccccgaacagagcccccctctgaggacctgggaagcctgcaccctggggccctactgtttcgagcgtctgggcatcctccatctcttcccaccatggctgatgcccttgcccatggagctgatgtcaactgggtcaatgggggccaagataatgccacaccgctgatccaggccacagctgctgtaagagccctgctgacctctccaccccaccctagggctctgacacctactcctgactctgggccctgcccttacctcctttccccaccacctgttccctagggcttccacccatagggagagatcaacaatagagactggttgctaagagtgtgtgatttggaggcagagaacctgagtttgaacccaggctctcacctcttacaggagaatcatttgaacccaggaggtggaggttgcagtgagccaagatcgcactacttcacttcagcctgggcaacagagtgagactctgcctcaaaaaaaaa

SEQ ID NO: 69120 - DNA, 865 bp, Homo sapiens
tgtatttttagtagagacggggtttcaccatgttggccaggacggtctcgatctcctgacctcgtgatccgcctgcctcggcctcccaaagtgttgggattacaggcgtgagccaccgcgcccggccaaagatagtgtcgttcatttcttaattccctcctcttcaggctacgactggcaaagatgagggaggctgaagcggcccaggggcaggcaggtaaagaatacacccaccccaccccccaggcccaacacctgaactctgggcttctggtccacggtgacctctctccctagtgcccagctgcattcattccgttatttaacaaatgcgtattgggcgcatgcgacgtgccaggccctggcaaggcataggtgctggcgcagtgccccggcgcgcacgttcccacccaggctcggagcgcgaggtccccaggtgggccccaaccgccggatcctgcccttctgcactggggcccagccgcctcccggcctttcctccctcccccaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcccttctggttcacttcttgggcgccaccttcgggcccgtagggtgttgggcgctgcggctcccgaggtgcggggagcagctgggggtttgcgagctccagtccagcaaggtgcgactccggggagcgaggcggcagcttcgatcctatatcccggaccgtaccagcctgct

SEQ ID NO: 69121 - DNA, 317 bp, Homo sapiens
agatggagtctcgctctgtcacccaggctggagtgcagtggtgcgatctcggcttactggaacctccacctcccaggttcaagcgattctgtgttattttcccatcctcagaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcaggtgcctgccccaatctgtcttc

SEQ ID NO: 69122 - DNA, 2766 bp, Homo sapiens
cccagcactgcctggaagtgtggggtgagagctcctcctaggacacccctttccccttggggaaagaattgtgcccccaggcccttccccgcggaggtccctctcctccttccccctcatctccccttcctgggacagaaagtgcctccacctgcatccccaggggcccggcctccagggcccgctggccccacagcaggcaagctgagatgacggtcaagctggatttcgaggagtgtctcaaggactcaccccgtttccgagcctctattgagctggtggaagccgaagtgtcagaattggagacccgtctggaaaagctcctgaaactgggcactggtctcctggaaagtgggcgccattaccttgctgccagccgcgccttcgttgtcggcatttgtgacctggcccgcctgggtccaccagagcccatgatggcggagtgtctggaaaaattcaccgtgagcctgaaccacaagctggacagccatgcggagcttctagatgccacccaacacacactgcagcagcagatccagaccctggtcaaggaaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcagatcaacgtgattgaggacaagaggaagtttgacatcatggagtttgtgctgcgtttggtggaggcccaggctacccatttccagcagggccatgaggagctgagccggctgtcccagtatcgaaaggagctgggcgcccagttgcaccagctggtcttgaattcagcacgagagaagagggacatggagcagagacacgtgctgctgaaacagaaggagctgggtggggaggagccagaaccaagcttaagagaggggcctggtggcctggtgatggaaggacatctcttcaaacgggccagcaacgcatttaagacctggagcagacgctggttcaccattcagagcaaccaactggtttaccagaagaagtacaaggaccctgtgactgtggtggtggatgaccttcgtctctgcacagtgaaactctgccctgactcagaaaggcggttctgctttgaggtggtgtccaccagcaagtcctgcctcctccaggctgactcagagcgcctcctgcagctgtgggtcagtgctgtgcagagcagcattgcttctgccttcaagtcaggctcgccttgatgacagcccccggggtccaggccagggctcaggacacctggccataggctctgctgccaccctgggctctggtggaatggccaggggaagggagcctgggggagtcgggcacgtggtggcccaggtccagagtgtggatggcaatgcccagtgctgcgactgccgggagccagccccggagtgggccagcatcaaccttggtgtcaccctctgcattcagtgttccggcatccacaggagccttggtgttcacttctccaaagtccggtctctgacccttgactcatgggagccagaactagtgaagctcatgtgtgagctgggaaatgtcatcatcaaccagatctatgaggcccgcgtggaggccatggcagtgaagaaaccagggcccagctgctcccggtgagcttggggtttagcctcccaggggaatgggggacccctggagcagaagagggaagactgcgtgcttctcccctcccacaggcaggagaaggaggcctggattcacgctaaatacgtggagaagaagttcctgaccaagctgcctgagattcgagggcgaagaggtggccgggggcgcccaagggggcagcctcctgtgcccccaaagccttccatcaggccccggccagggagcttgagatccaagccagagcccccctctgaggacctgggaagcctgcaccctggggccctactgtttcgagcgtctgggcatcctccatctcttcccaccatggctgatgcccttgcccatggagctgatgtcaactgggtcaatgggggccaagataatgccacaccgctgatccaggccacagctgctaattctcttctggcctgtgagtttctcctccagaacggggcgaacgtgaaccaagcggacagtgcgggccggggcccgctgcaccacgcaaccattcttggccacacggggctcgcctgcctgttcctgaaacggggagctgatctgggggctcgagactctgaaggcagggaccctctgaccatcgccatggaaacagccaacgctgacatcgtcaccctgctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcaaaaaaaaaaaaaaagaaaaaacagagagcaagaagcaaagaagcgggaagaagaagagagggagcgggcgagcagcgcccagccacgaggagaagaccagaggagagaaaagaggaaggaggggcgagcagaaggcagaggggtgcaccgagtcaccgaacgaggg

SEQ ID NO: 69123 - DNA, 2980 bp, Homo sapiens
cccagcactgcctggaagtgtggggtgagagctcctcctaggacacccctttccccttggggaaagaattgtgcccccaggcccttccccgcggaggtccctctcctccttccccctcatctccccttcctgggacagaaagtgcctccacctgcatccccaggggcccggcctccagggcccgctggccccacagcaggcaagctgagatgacggtcaagctggatttcgaggagtgtctcaaggactcaccccgtttccgagcctctattgagctggtggaagccgaagtgtcagaattggagacccgtctggaaaagctcctgaaactgggcactggtctcctggaaagtgggcgccattaccttgctgccagccgcgccttcgttgtcggcatttgtgacctggcccgcctgggtccaccagagcccatgatggcggagtgtctggaaaaattcaccgtgagcctgaaccacaagctggacagccatgcggagcttctagatgccacccaacacacactgcagcagcagatccagaccctggtcaaggaaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcagatcaacgtgattgaggacaagaggaagtttgacatcatggagtttgtgctgcgtttggtggaggcccaggctacccatttccagcagggccatgaggagctgagccggctgtcccagtatcgaaaggagctgggcgcccagttgcaccagctggtcttgaattcagcacgagagaagagggacatggagcagagacacgtgctgctgaaacagaaggagctgggtggggaggagccagaaccaagcttaagagaggggcctggtggcctggtgatggaaggacatctcttcaaacgggccagcaacgcatttaagacctggagcagacgctggttcaccattcagagcaaccaactggtttaccagaagaagtacaaggaccctgtgactgtggtggtggatgaccttcgtctctgcacagtgaaactctgccctgactcagaaaggcggttctgctttgaggtggtgtccaccagcaagtcctgcctcctccaggctgactcagagcgcctcctgcagctgtgggtcagtgctgtgcagagcagcattgcttctgccttcaagtcaggctcgccttgatgacagcccccggggtccaggccagggctcaggacacctggccataggctctgctgccaccctgggctctggtggaatggccaggggaagggagcctgggggagtcgggcacgtggtggcccaggtccagagtgtggatggcaatgcccagtgctgcgactgccgggagccagccccggagtgggccagcatcaaccttggtgtcaccctctgcattcagtgttccggcatccacaggagccttggtgttcacttctccaaagtccggtctctgacccttgactcatgggagccagaactagtgaagctcatgtgtgagctgggaaatgtcatcatcaaccagatctatgaggcccgcgtggaggccatggcagtgaagaaaccagggcccagctgctcccggcaggagaaggaggcctggattcacgctaaatacgtggagaagaagttcctgaccaagctgcctgagattcgagggcgaagaggtggccgggggcgcccaagggggcagcctcctgtgcccccaaagccttccatcaggccccggccagggagcttgagatccaagccagagcccccctctgaggacctgggaagcctgcaccctggggccctactgtttcgagcgtctgggcatcctccatctcttcccaccatggctgatgcccttgcccatggagctgatgtcaactgggtcaatgggggccaagataatgccacaccgctgatccaggccacagctgctaattctcttctggcctgtgagtttctcctccagaacggggcgaacgtgaaccaagcggacagtgcgggccggggcccgctgcaccacgcaaccattcttggccacacggggctcgcctgcctgttcctgaaacggggagctgatctgggggctcgagactctgaaggcagggaccctctgaccatcgccatggaaacagccaacgctgacatcgtcaccctgctacgactggcaaagatgagggaggctgaagcggcccaggggcaggcaggtaaagaatacacccaccccaccccccaggcccaacacctgaactctgggcttctggtccacggtgacctctctccctagtgcccagctgcattcattccgttatttaacaaatgcgtattgggcgcatgcgacgtgccaggccctggcaaggcataggtgctggcgcagtgccccggcgcgcacgttcccacccaggctcggagcgcgaggtccccaggtgggccccaaccgccggatcctgcccttctgcactggggcccagccgcctcccggcctttcctccctcccccaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcccttctggttcacttcttgggcgccaccttcgggcccgtagggtgttgggcgctgcggctcccgaggtgcggggagcagctgggggtttgcgagctccagtccagcaaggtgcgactccggggagcgaggcggcagcttcgatcctatatcccggaccgtaccagcctgct

SEQ ID NO: 69124 - DNA, 2054 bp, Homo sapiens
cccagcactgcctggaagtgtggggtgagagctcctcctaggacacccctttccccttggggaaagaattgtgcccccaggcccttccccgcggaggtccctctcctccttccccctcatctccccttcctgggacagaaagtgcctccacctgcatccccaggggcccggcctccagggcccgctggccccacagcaggcaagctgagatgacggtcaagctggatttcgaggagtgtctcaaggactcaccccgtttccgagcctctattgagctggtggaagccgaagtgtcagaattggagacccgtctggaaaagctcctgaaactgggcactggtctcctggaaagtgggcgccattaccttgctgccagccgcgccttcgttgtcggcatttgtgacctggcccgcctgggtccaccagagcccatgatggcggagtgtctggaaaaattcaccgtgagcctgaaccacaagctggacagccatgcggagcttctagatgccacccaacacacactgcagcagcagatccagaccctggtcaaggaaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcagatcaacgtgattgaggacaagaggaagtttgacatcatggagtttgtgctgcgtttggtggaggcccaggctacccatttccagcagggccatgaggagctgagccggctgtcccagtatcgaaaggagctgggcgcccagttgcaccagctggtcttgaattcagcacgagagaagagggacatggagcagagacacgtgctgctgaaacagaaggagctgggtggggaggagccagaaccaagcttaagagaggggcctggtggcctggtgatggaaggacatctcttcaaacgggccagcaacgcatttaagacctggagcagacgctggttcaccattcagagcaaccaactggtttaccagaagaagtacaaggaccctgtgactgtggtggtggatgaccttcgtctctgcacagtgaaactctgccctgactcagaaaggcggttctgctttgaggtggtgtccaccagcaagtcctgcctcctccaggctgactcagagcgcctcctgcagctgtgggtcagtgctgtgcagagcagcattgcttctgccttcaagtcaggctcgccttgatgacagcccccggggtccaggccagggctcaggacacctggccataggctctgctgccaccctgggctctggtggaatggccaggggaagggagcctgggggagtcgggcacgtggtggcccaggtccagagtgtggatggcaatgcccagtgctgcgactgccgggagccagccccggagtgggccagcatcaaccttggtgtcaccctctgcattcagtgttccggcatccacaggagccttggtgttcacttctccaaagtccggtctctgacccttgactcatgggagccagaactagtgaagctcatgtgtgagctgggaaatgtcatcatcaaccagatctatgaggcccgcgtggaggccatggcagtgaagaaaccagggcccagctgctcccggtgagcttggggtttagcctcccaggggaatgggggacccctggagcagaagagggaagactgcgtgcttctcccctcccacaggcaggagaaggaggcctggattcacgctaaatacgtggagaagaagttcctgaccaagctgcctgagattcgagggcgaagaggtggccgggggcgcccaagggggcagcctcctgtgcccccaaagccttccatcaggccccggccagggagcttgagatccaagccaggtatagggttggttgggcattcattgagcatctgctgtgtgctcggcatcgtgccaggtagcgccgggaggcacagagtgtg

SEQ ID NO: 69125 - DNA, 1113 bp, Homo sapiens
aaggggtgccaacagcacaagaaaaggagagagagagggggtgggtttggctggagcgtcaggggttgagagctgaggccaagtgtggttggaccagatgaggtgatgatgccgtctctcccccacaccctagggactcgtacacatgcatacgcatacttacacatacccacacttgcatcactctattccctccacagtcccaagctccccatcatttagaagagacctgtcccattatagcattgggacactgctgagggttttcttcccagactcggagctgcttccccctaacagaaccaaatcccccgaacagagcccccctctgaggacctgggaagcctgcaccctggggccctactgtttcgagcgtctgggcatcctccatctcttcccaccatggctgatgcccttgcccatggagctgatgtcaactgggtcaatgggggccaagataatgccacaccgctgatccaggccacagctgctaattctcttctggcctgtgagtttctcctccagaacggggcgaacgtgaaccaagcggacagtgcgggccggggcccgctgcaccacgcaaccattcttggccacacggggctcgcctgcctgttcctgaaacggggagctgatctgggggctcgagactctgaaggcagggaccctctgaccatcgccatggaaacagccaacgctgacatcgtcaccctgctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcaaaaaaaaaaaaaaagaaaaaacagagagcaagaagcaaagaagcgggaagaagaagagagggagcgggcgagcagcgcccagccacgaggagaagaccagaggagagaaaagaggaaggaggggcgagcagaaggcagaggggtgcaccgagtcaccgaacgaggg

SEQ ID NO: 69126 - DNA, 571 bp, Homo sapiens
tgtatttttagtagagacggggtttcaccatgttggccaggacggtctcgatctcctgacctcgtgatccgcctgcctcggcctcccaaagtgttgggattacaggcgtgagccaccgcgcccggccaaagatagtgtcgttcatttcttaattccctcctcttcaggctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcccttctggttcacttcttgggcgccaccttcgggcccgtagggtgttgggcgctgcggctcccgaggtgcggggagcagctgggggtttgcgagctccagtccagcaaggtgcgactccggggagcgaggcggcagcttcgatcctatatcccggaccgtaccagcctgct

SEQ ID NO: 69127 - DNA, 541 bp, Homo sapiens
cttggcccaccctgagaggcgtaattcgcccatcaacattgctgtcaggcatctttttagcactagacgtgaccccgggggtgggggcagatgaacggaacgcaacccagctcaaaggatgggaagttgtgggggaggctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcccttctggttcacttcttgggcgccaccttcgggcccgtagggtgttgggcgctgcggctcccgaggtgcggggagcagctgggggtttgcgagctccagtccagcaaggtgcgactccggggagcgaggcggcagcttcgatcctatatcccggaccgtaccagcctgct

SEQ ID NO: 69128 - DNA, 460 bp, Homo sapiens
gcctcggaaaggggctgggccagcgccggggccaggctcgagaaaggctgcgcgaagctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcccttctggttcacttcttgggcgccaccttcgggcccgtagggtgttgggcgctgcggctcccgaggtgcggggagcagctgggggtttgcgagctccagtccagcaaggtgcgactccggggagcgaggcggcagcttcgatcctatatcccggaccgtaccagcctgct

SEQ ID NO: 69129 - DNA, 486 bp, Homo sapiens
gcctcggaaaggggctgggccagcgccggggccaggctcgagaaaggctgcgcgaagtgtgcactgggacgtggagtagaaggctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcccttctggttcacttcttgggcgccaccttcgggcccgtagggtgttgggcgctgcggctcccgaggtgcggggagcagctgggggtttgcgagctccagtccagcaaggtgcgactccggggagcgaggcggcagcttcgatcctatatcccggaccgtaccagcctgct

SEQ ID NO: 69130 - DNA, 750 bp, Homo sapiens
taaattgtagcaatagacattttattagaaaaagaattttactgccatctgctggaaagttgtcttcataactatatgaaatctgggttgtccaagataggaatagcatcctttagatgttccaatctgcacaattgtccacccttctctggaatgtctcgtggaacagtcagcccaggtgtctgtcctctcagtaagatcctcatgggcaaaaagcacagcctctcttccgtccctcatcctaaagctgcctatgtctgtaatgatttccttctcttacagacgctggttcaccattcagagcaaccaactggtttaccagaagaagtacaaggtgagtggacctgggtcctggatgcctgggccccagggagactcagctcttgcctgcagctggacatctggccccttatcaccttatcctgccaggaccctgtgactgtggtggtggatgaccttcgtctctgcacagtgaaactctgccctgactcagaaaggcggttctgctttgaggtggtgtccaccagcaagtgagtgcaatccccaggggtgatactctaatatatctaaacaactgccaatctgaaaggcagggcccaccacaatggaggccccccatgcagctccagactttaatttaattctttggcggctggactggggggccattgtggaagagggtacagggtgatgggggatatttaggagaatattaccaactggtacagaagtctttcaatgcaactggaa

SEQ ID NO: 69131 - DNA, 446 bp, Homo sapiens
ttccagcagggccatgaggagctgagccggctgtcccagtatcgaaaggagctgggcgcccaggtggggccccagggcacagcaggtggtagagggaggttagggactcctaactggggggccttggacatctgagatgcccttcctgtgcccagttgcaccagctggtcttgaattcagcacgagagaagagggacatggagcagagacacgtgctgctgaaacagaaggtgaggggccaggtgcggtggcccacgaccgtcatcccaacatgttgggaggctgaggtgggaagattgcttgaggcctggagttcaagattagcctaggcatcgtagtgaaactccatctctacagaaaattttaaaattagctggtgtggtggcatgcacctctagttctagctactcaggaggctgaggtgggaggattgcttgagcccagga

SEQ ID NO: 69132 - DNA, 518 bp, Homo sapiens
agcttgtactatggatttatatatgaatacatgcaaagagctagagccaagcctagcttggttacagttagctgtaaccccttccacactcctgattaccacactccaccctcccattctctgaactggcgccaccctaagacatcttgaaatccaccactagggatgccaccctcaaccccccttctcgacttctccatgcagaattctcttctggcctgtgagtttctcctccagaacggggcgaacgtgaaccaagcggacagtgcgggccggggcccgctgcaccacgcaaccattcttggccacacggggtagggatgatggcatggggaggaaggctgggagaagttgggcggccggctgaccctggctcttctctccaggctcgcctgcctgttcctgaaacggggagctgatctgggggctcgagactctgaaggcagggaccctctgaccatcgccatggaaacagccaacgctgacatcgtcaccctgtaagaatgcctgaaggggcg

SEQ ID NO: 69133 - DNA, 832 bp, Homo sapiens
cccagcactgcctggaagtgtggggtgagagctcctcctaggacacccctttccccttggggaaagaattgtgcccccaggcccttccccgcggaggtccctctcctccttccccctcatctccccttcctgggacagaaagtgcctccacctgcatccccaggggcccggcctccagggcccgctggccccacagcaggcaagctgagatgacggtcaagctggatttcgaggagtgtctcaaggactcaccccgtttccgagcctctattgagctggtggaagccgaagtgtcagaattggagacccgtctggaaaagctcctgaaactgggcactggtctcctggaaagtgggcgccattaccttgctgccagccgcgccttcgttgtcggcatttgtgacctggcccgcctgggtccaccagagcccatgatggcggagtgtctggaaaaattcaccgtgagcctgaaccacaagctggacagccatgcggagcttctagatgccacccaacacacactgcagcagcagatccagaccctggtcaaggagtgagatggggccgggcgcagtggctcatgcctgtaatcccaacactttggaaggccaaggcgggaggattgcttgagcccaggagttggacaccaacctagccaacatggcgaaactgtctccacaaaaaatacaaaaattaggccgggcacggtggctcatgcctatgatcccggcattttgggaggccaaggcgggcggatcacctgaggtcgggagttcgagaccagcctgtctaacatggcaaaaccccagctctactaaaaaatacgaaaaaa

SEQ ID NO: 69134 - DNA, 2682 bp, Homo sapiens
cccagcactgcctggaagtgtggggtgagagctcctcctaggacacccctttccccttggggaaagaattgtgcccccaggcccttccccgcggaggtccctctcctccttccccctcatctccccttcctgggacagaaagtgcctccacctgcatccccaggggcccggcctccagggcccgctggccccacagcaggcaagctgagatgacggtcaagctggatttcgaggagtgtctcaaggactcaccccgtttccgagcctctattgagctggtggaagccgaagtgtcagaattggagacccgtctggaaaagctcctgaaactgggcactggtctcctggaaagtgggcgccattaccttgctgccagccgcgccttcgttgtcggcatttgtgacctggcccgcctgggtccaccagagcccatgatggcggagtgtctggaaaaattcaccgtgagcctgaaccacaagctggacagccatgcggagcttctagatgccacccaacacacactgcagcagcagatccagaccctggtcaaggaaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcagatcaacgtgattgaggacaagaggaagtttgacatcatggagtttgtgctgcgtttggtggaggcccaggctacccatttccagcagggccatgaggagctgagccggctgtcccagtatcgaaaggagctgggcgcccagttgcaccagctggtcttgaattcagcacgagagaagagggacatggagcagagacacgtgctgctgaaacagaaggagctgggtggggaggagccagaaccaagcttaagagaggggcctggtggcctggtgatggaaggacatctcttcaaacgggccagcaacgcatttaagacctggagcagacgctggttcaccattcagagcaaccaactggtttaccagaagaagtacaaggaccctgtgactgtggtggtggatgaccttcgtctctgcacagtgaaactctgccctgactcagaaaggcggttctgctttgaggtggtgtccaccagcaagtcctgcctcctccaggctgactcagagcgcctcctgcagctgtgggtcagtgctgtgcagagcagcattgcttctgccttcaagtcaggctcgccttgatgacagcccccggggtccaggccagggctcaggacacctggccataggctctgctgccaccctgggctctggtggaatggccaggggaagggagcctgggggagtcgggcacgtggtggcccaggtccagagtgtggatggcaatgcccagtgctgcgactgccgggagccagccccggagtgggccagcatcaaccttggtgtcaccctctgcattcagtgttccggcatccacaggagccttggtgttcacttctccaaagtccggtctctgacccttgactcatgggagccagaactagtgaagctcatgtgtgagctgggaaatgtcatcatcaaccagatctatgaggcccgcgtggaggccatggcagtgaagaaaccagggcccagctgctcccggcaggagaaggaggcctggattcacgctaaatacgtggagaagaagttcctgaccaagctgcctgagattcgagggcgaagaggtggccgggggcgcccaagggggcagcctcctgtgcccccaaagccttccatcaggccccggccagggagcttgagatccaagccagagcccccctctgaggacctgggaagcctgcaccctggggccctactgtttcgagcgtctgggcatcctccatctcttcccaccatggctgatgcccttgcccatggagctgatgtcaactgggtcaatgggggccaagataatgccacaccgctgatccaggccacagctgctaattctcttctggcctgtgagtttctcctccagaacggggcgaacgtgaaccaagcggacagtgcgggccggggcccgctgcaccacgcaaccattcttggccacacggggctcgcctgcctgttcctgaaacggggagctgatctgggggctcgagactctgaaggcagggaccctctgaccatcgccatggaaacagccaacgctgacatcgtcaccctgctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcaaaaaaaaaaaaaaagaaaaaacagagagcaagaagcaaagaagcgggaagaagaagagagggagcgggcgagcagcgcccagccacgaggagaagaccagaggagagaaaagaggaaggaggggcgagcagaaggcagaggggtgcaccgagtcaccgaacgaggg

SEQ ID NO: 69135 - DNA, 2731 bp, Homo sapiens
cccagcactgcctggaagtgtggggtgagagctcctcctaggacacccctttccccttggggaaagaattgtgcccccaggcccttccccgcggaggtccctctcctccttccccctcatctccccttcctgggacagaaagtgcctccacctgcatccccaggggcccggcctccagggcccgctggccccacagcaggcaagctgagatgacggtcaagctggatttcgaggagtgtctcaaggactcaccccgtttccgacagaccagatggacccaagctctcttcccatgaccccctctttcccagagcctctattgagctggtggaagccgaagtgtcagaattggagacccgtctggaaaagctcctgaaactgggcactggtctcctggaaagtgggcgccattaccttgctgccagccgcgccttcgttgtcggcatttgtgacctggcccgcctgggtccaccagagcccatgatggcggagtgtctggaaaaattcaccgtgagcctgaaccacaagctggacagccatgcggagcttctagatgccacccaacacacactgcagcagcagatccagaccctggtcaaggaaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcagatcaacgtgattgaggacaagaggaagtttgacatcatggagtttgtgctgcgtttggtggaggcccaggctacccatttccagcagggccatgaggagctgagccggctgtcccagtatcgaaaggagctgggcgcccagttgcaccagctggtcttgaattcagcacgagagaagagggacatggagcagagacacgtgctgctgaaacagaaggagctgggtggggaggagccagaaccaagcttaagagaggggcctggtggcctggtgatggaaggacatctcttcaaacgggccagcaacgcatttaagacctggagcagacgctggttcaccattcagagcaaccaactggtttaccagaagaagtacaaggaccctgtgactgtggtggtggatgaccttcgtctctgcacagtgaaactctgccctgactcagaaaggcggttctgctttgaggtggtgtccaccagcaagtcctgcctcctccaggctgactcagagcgcctcctgcagctgtgggtcagtgctgtgcagagcagcattgcttctgccttcaagtcaggctcgccttgatgacagcccccggggtccaggccagggctcaggacacctggccataggctctgctgccaccctgggctctggtggaatggccaggggaagggagcctgggggagtcgggcacgtggtggcccaggtccagagtgtggatggcaatgcccagtgctgcgactgccgggagccagccccggagtgggccagcatcaaccttggtgtcaccctctgcattcagtgttccggcatccacaggagccttggtgttcacttctccaaagtccggtctctgacccttgactcatgggagccagaactagtgaagctcatgtgtgagctgggaaatgtcatcatcaaccagatctatgaggcccgcgtggaggccatggcagtgaagaaaccagggcccagctgctcccggcaggagaaggaggcctggattcacgctaaatacgtggagaagaagttcctgaccaagctgcctgagattcgagggcgaagaggtggccgggggcgcccaagggggcagcctcctgtgcccccaaagccttccatcaggccccggccagggagcttgagatccaagccagagcccccctctgaggacctgggaagcctgcaccctggggccctactgtttcgagcgtctgggcatcctccatctcttcccaccatggctgatgcccttgcccatggagctgatgtcaactgggtcaatgggggccaagataatgccacaccgctgatccaggccacagctgctaattctcttctggcctgtgagtttctcctccagaacggggcgaacgtgaaccaagcggacagtgcgggccggggcccgctgcaccacgcaaccattcttggccacacggggctcgcctgcctgttcctgaaacggggagctgatctgggggctcgagactctgaaggcagggaccctctgaccatcgccatggaaacagccaacgctgacatcgtcaccctgctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcaaaaaaaaaaaaaaagaaaaaacagagagcaagaagcaaagaagcgggaagaagaagagagggagcgggcgagcagcgcccagccacgaggagaagaccagaggagagaaaagaggaaggaggggcgagcagaaggcagaggggtgcaccgagtcaccgaacgaggg

SEQ ID NO: 69136 - DNA, 2191 bp, Homo sapiens
cccagcactgcctggaagtgtggggtgagagctcctcctaggacacccctttccccttggggaaagaattgtgcccccaggcccttccccgcggaggtccctctcctccttccccctcatctccccttcctgggacagaaagtgcctccacctgcatccccaggggcccggcctccagggcccgctggccccacagcaggcaagctgagatgacggtcaagctggatttcgaggagtgtctcaaggactcaccccgtttccgagcctctattgagctggtggaagccgaagtgtcagaattggagacccgtctggaaaagctcctgaaactgggcactggtctcctggaaagtgggcgccattaccttgctgccagccgcgccttcgttgtcggcatttgtgacctggcccgcctgggtccaccagagcccatgatggcggagtgtctggaaaaattcaccgtgagcctgaaccacaagctggacagccatgcggagcttctagatgccacccaacacacactgcagcagcagatccagaccctggtcaaggaaggtctgcggggtttccgagaggctcgccgggatttctggcggggggctgagagcctggaggctgccctgacccacaacgcagaggttcccaggcgccgggcccaggaggcagaagaggcaggagctgctttgaggacggctcgagctgggtaccggggacgggcactggattatgccctgcagatcaacgtgattgaggacaagaggaagtttgacatcatggagtttgtgctgcgtttggtggaggcccaggctacccatttccagcagggccatgaggagctgagccggctgtcccagtatcgaaaggagctgggcgcccagttgcaccagctggtcttgaattcagcacgagagaagagggacatggagcagagacacgtgctgctgaaacagaaggagctgggtggggaggagccagaaccaagcttaagagaggggcctggtggcctggtgatggaaggacatctcttcaaacgggccagcaacgcatttaagacctggagcagacgctggttcaccattcagagcaaccaactggtttaccagaagaagtacaaggaccctgtgactgtggtggtggatgaccttcgtctctgcacagtgaaactctgccctgactcagaaaggcggttctgctttgaggtggtgtccaccagcaagtcctgcctcctccaggctgactcagagcgcctcctgcagctgtgggtcagtgctgtgcagagcagcattgcttctgccttcaagtcaggctcgccttgatgacagcccccggggtccaggccagggctcaggacacctggccataggctctgctgccaccctgggctctggtggaatggccaggggaagggagcctgggggagtcgggcacgtggtggcccaggtccagagtgtggatggcaatgcccagtgctgcgactgccgggagccagccccggagtgggccagcatcaaccttggtgtcaccctctgcattcagtgttccggcatccacaggttactccacaaggcccatgcgggagccccactccttcgggccacagtgcggctccaatacagagcgcatcacaccggcccctcttccttccctgtcctggcttcctctcttagcttctggctttgtcactgggtaccaggcctgggcccaagcctctggggtgccagttggacccaggcgggcctagcccctctgtgtcctagtctggccagaattgggggatacccagaatttgttggcttggttggaagaagtgtggggtcaaggctgctgagggtgggggagccagtgaagactaggcagagaaacggtcatgaggccttagcaagtatctaaggccctcgccccccacctcagtgtggtggaagggaggtgacatgggagaggttgtccaggccaaagtgtcacaagtgtcactagagaagggaggtggctggagtgatgagggccttgaaatgaaacctaaggaagaaggaatggtgacgaggcagagtcctgccagggccaggtcaaggctacatggcggttacatggccgcagctgccctgcctcctgggccagcacctctgcacgggcccccatgccagccttgcctcccagtgtcttcaggagcagcagcagctccccaggccactgc

SEQ ID NO: 69137 - DNA, 1171 bp, Homo sapiens
tgagacagtctcgctctgtcccccaggctggagtgcaatggtgcgatctcggctcactgcaagctccgcctcccgggttcacaccattctcctgcctcagctgcctgagtagctgggactacaggcgccagccagcatgcccggctaattttttgtattgttagtagagatagggtttcaccgtgttagccaggatggtctggatctcctgaccttgtgatccacccgcctcggcctcccaaagtgctgggattactggcgtgagccactgtgcccggcctacaggagacttttaacaagttattaacctctcagcctcatctgtaaaatagtaacatacctcaaaagcttgtactatggatttatatatgaatacatgcaaagagctagagccaagcctagcttggttacagttagctgtaaccccttccacactcctgattaccacactccaccctcccattctctgaactggcgccaccctaagacatcttgaaatccaccactagggatgccaccctcaaccccccttctcgacttctccatgcagaattctcttctggcctgtgagtttctcctccagaacggggcgaacgtgaaccaagcggacagtgcgggccggggcccgctgcaccacgcaaccattcttggccacacggggctcgcctgcctgttcctgaaacggggagctgatctgggggctcgagactctgaaggcagggaccctctgaccatcgccatggaaacagccaacgctgacatcgtcaccctgctacgactggcaaagatgagggaggctgaagcggcccaggggcaggcaggagatgagacgtatcttgacatcttccgcgacttctccctcatggcgtcagacgacccggagaagctgagccgtcgcagtcatgacctccacacgctgtgacccgaggcccacggggcccgcgcctgcctcccttccccgccaccgggccctctgccattaaagcctccgtgcttcgctcttcaaaaaaaaaaaaaaagaaaaaacagagagcaagaagcaaagaagcgggaagaagaagagagggagcgggcgagcagcgcccagccacgaggagaagaccagaggagagaaaagaggaaggaggggcgagcagaaggcagaggggtgcaccgagtcaccgaacgaggg

SEQ ID NO: 69138 - DNA, 589 bp, Homo sapiens
tggagatggggcaccctttaccctaggccccttggccaccctttcttcccctctctcccccagggctcaggacacctggccataggctctgctgccaccctgggctctggtggaatggccaggggaagggagcctgggggagtcgggcacgtggtggcccaggtccagagtgtggatggcaatgcccagtgctgcgactgccgggagccagccccggagtgggccagcatcaaccttggtgtcaccctctgcattcagtgttccggcatccacaggttactccacaaggcccatgcgggagccccactccttcgggccacagtgcggctccaatacagagcgcatcacaccggcccctcttccttccctgtcctggcttcctctcttagcttctggctttgtcactgggtaccaggcctgggcccaagcctctggggtgccagttggacccaggcgggcctagcccctctgtgtcctagtctggccagaattgggggatacccagaatttgttggcttggttggaagaagtgtggggtcaaggctgctgagggtgggggagccagtgaagactaggcagagaaacggtc

SEQ ID NO: 69139 - DNA, 570 bp, Homo sapiens
gcaagagcaagggctgcagccatggaggacccttcagagtccctcaaggctgtgtttggcctgggacattccacaggcacgatgagcatgaagaagaggttctgagaggaccttgtgtgccaccctgacctcatgcacaccctgctggatgaccacaaaaaaggaacagatcccaccacctacacctggggaaccctgagaccagccctccctgcacacccagggacgctccagaccaggtcctgacccacgcacggggatatggggaccagaggcccacccacacactcagggacataggaaccagagccaactgtccttgtcctcttctaccatgtacctcaggagcttaaggcagtggcttatgtgcctggaaaagcagaagattgcagaaatcgtgttttggagggaaatgaacttgcaggggttttttggtgacaggaaatgctgttccctgcctggatcttaaatttgtttgcgaagcatctttctgaaggtggtctgtctttcaagggtcagagctttgttttccaaattcaaaattataattgattttcatgctatcacaca

SEQ ID NO: 69140 - DNA, 436 bp, Homo sapiens
taagaactgtttttctaacagtttcttatattaattatattgttgttttaaaaattggatttttaagacctcataataataagaggcagtttttatacttgcagattttaaaactaagaatgagaattccaaaactgtaaaattaatataaatgtttgcattactgtgaagataaagttacattcagtttatcaggacttttatggtattgcaattcatgatttctttaaataagtttgtctactttatgtacaaaatatatacttctctgaaactggttttagatgtgttatcctttatatttttataaatttcattgtataggtagattataagaattaaatgtgaagaaattgatttccacagaatgtactatgaaaatttgtaagaaagagtagttttaggtgtaattattaataaaaatctctgaaacact

SEQ ID NO: 69141 - DNA, 474 bp, Homo sapiens
gtgtgaagtaggcttttagttgcagttttggcaagaggctttaagacttaaggcacgtgggattttgacctaaaagtttaggatatctttgtccagagaaattggtaatttctatagagacaatgtgcaatactgggctttaagcacatatgcgcaggcctcaatgaagcagagtttgagtgagggtgatggagacatattggcttcagcaaagacagagaatctggaagtggggctcacccaaatgctggcctcatggatgtcctcaccagatgccagcccaaggtgaggcttagcaagctactgtagtggtgctggcatcaacaaaggcactggcatgtgcaagtggtctcatgcaggctactgcagcttgaccttggcctacattaaatatgcatgtgtgagcagcaaaggcctcactcatcagatgctgctaactcgacaccagaaaacaattttattcgtggcaaggat

SEQ ID NO: 69142 - DNA, 334 bp, Homo sapiens
taaaataactaactttttttggtataaagtacgagacacccacacccctatctacccctcctccctgtgggtccgaaccccggcccccccacccctccctcagcccaccagggtccagggagatgttcgttctcgctttaagtcaggagtcacaaatgactttttttttttcaattaaggaaaaagctccatctctacctttaacatcacccagacccccgcccctgcccgtgccccacgctgctgctaacgacagtatgatgcttactctgctactcggaaactatttttatgtaattaatgtatgctttcttgtttataaatgcctgattta

SEQ ID NO: 69143 - DNA, 348 bp, Homo sapiens
cccctagccacggggggctactagtccacggttggctatgtgtgaggcccttcatctaagtgattgtgtattcagtttaattctcattatatttctatactgaaagaagatttttaacgaagggaaaaacaacagcaataacattcatatctctggagcagctaactcatacacgtaatgtctgcttttcgtacagaactagccaatgtaaaaacagttcacctgtaaatactttttcctttttcaccgttgtattatacatgtatatgctgggtcctttttcagaaactcttttcttacctgagagttgtcttgttttctgggctgtttttaactgaggaaaaaaaa

SEQ ID NO: 69144 - DNA, 4360 bp, Homo sapiens
gggagagtgggtcttggtgctccatcccaaacctgctgcagccgtgggtgaggtcacccggaatggcaggacaaggtccactctgttctctcggagatgacttgtccctcagcacagcctccacgtgcctgttgcgcgtggcctaagggcctttatgcaaagtggacttggtctcctggggggtgccctggaatctgccttctgcgccactcagggtcgtttgtggccggagtgcatggggctctgactgccatgtgccagccacggggctggtggagggaccctgccctgggaaccacaggtgccaacaaaacctttcattgatcgcaggtctcctctgagcctccggcctccataagacccaaaacagatgacacctcttcccagtcccccgcgccttccgaaaaggacaagccgtccagctggctgcggaccttggccggctcttccaataagagcctgggctgtgttcaccctcgccagcgcctctctgctttccgaccctggtcccccgcagtgtcagcgagtgagaaagagctctccccacacctcccggccctcatccgagacagcttctactcctacaagagctttgagacagccgtggcgcccaacgtggccctcgcaccgccggcccagcagaaggttgtgagcagccctccgtgtgccgccgccgtctcccgggcccccgagcctctcgccacttgcacccagcctcggaagcggaagctgactgtggacaccccaggagccccagagacgctggcgcccgtggctgccccagaggaggacaaggactcggaggcggaggtggaagttgaaagcagggaggaattcacctcctccttgtcctcgctctcttccccgtcctttacctcatccagctccgccaaggacctgggctccccgggtgcgcgtgccctgccctcggccgtccctgatgctgcggcccctgccgacgcccccagtgggctggaggcggagctggagcacctgcggcaggcactggagggcggcctggacaccaaggaagccaaagagaagttcctgcatgaggtggtcaagatgcgcgtgaagcaggaggagaagctcagcgcagccctgcaggccaagcgcagcctccaccaggagctggagttcctacgcgtggccaagaaggagaagctgcgggaggccacggaggccaagcgtaacctgcggaaggagatcgagcgtctccgcgccgagaacgagaagaagatgaaagaggccaacgagtcacggctgcgcctgaagcgggagctggagcaggcgcggcaggcccgggtgtgcgacaagggctgcgaggcgggccgcctgcgcgccaagtactcggcccagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttcagcgacaaggacccaggtcttcctgctgctgccagggagagcagggacagtgccgcgtgcgagatgagctcgaacactgcccgccttactgccgcctaccccgcccgccacgccgccgtcgatgccagcgctgtccccacgggtaccaggaagtgcagagccgcacaggagctgccccggagctgaggggacggtcttcggctcctctgcaccccgtgattctgcccacgctcctccaccacgaggcactgacctgcgtcgggtggtgaccgtggctggcggtcacgccctcagcccctccgggcacacgtgccgcctgaccgggcgacccttttcagttcggcaaacgtcgctcccttcattttgggactgaggctgcagcattggaacaaaagagcattatttcaatttttctttctttttttttgttcgttcatttaaacgtatatttagaactgcactttgtccacaaccttcccttctctttctattccccagtgaactgaggtttttaccgatttatagagcagtcaaatccgaagtgctcgagtgcttagaaaccccctctggtgcttggttgaacaagggaatcacaagaaaacgaaaatgcaaaaactgaacttcgggggtcgttctgtgccttccagcatcttgtacagcaaatcctgactcgtgtctttttacccccaagatatctgtcttcagtagcgactgaatctgccactctcagaataagttccttgcatttattccaaataatctcgtttactctcacctgtttatgcaaattgtataaggtttcttatgcccaagcttgaaaaatgatttcccagtagacaagaggcggctacctatcctacagttacggtatttatttacataagaagatcttacaggagttctttgcttgaatccgttctaacacccgcggcagctgcacgcgctcacagaaggtggaggttacttgcccaggtacagacgacctcggggcagtgacgagcaaagaccagagactgctgagccctcgcatctgggtggcggaattgcctgcggggttttgcccttggtttactgaggggggtcttggttgctgctgaagccccccaccccttctaaagtgcaatgcaaaagggacatcatgtatatgcagcgtttgtttggaattttctttgcttttgttttctttgcggttgttctgtgtgcatggattccacacctctgccgtaggtagatccgtcagcgggcattattaccgtgtcttgtaaaagggtcggttttgttatgcaacacgcagaatgctgtttttagccttgttttaccagagttgttttttttttcagttatttcttcaagggaaactaaatgatttagttggagcaaagctttaagtgtgttggcgtgcttctgtgtggctgtcctgtgtcgccaggtcgaagatcacagtgaggtagaggccctgccccatccccagggccgccaggcttgctccgtttgctttgagtttttagaccccagagggagatgagcttttccaagctgtgtctgggccagagcctctccttgcccttgctccatcccgacggtcaccgttgggtccacgcctccaccgccccatcttgccccaaacggaaagcgctgtatctgcagtggcagcccttccccacttcggctctgggagggtccagccagtgtcacctgggcccaccctttcctgcagctgccaggcccgtgcggtcagtgggacccggacgtgggcaggcgagctcgggaccctcccaggcagttcccacagctcttgcctcggctcaccagggtcacttccactgtcaggggcctgagggggcagctgtggctgcagggctgctctggactgaggggtcccaggccccgaggggtgcacgcctggctccccttggcacaggtgcgagtccgtttcttttcagcagaagggggaagaggtgtccgctgtgtgggctgctgactcctctgtgtgtgaggcccttcatctaagtgattgtgtattcagtttaattctcattatatttctatactgaaagaagatttttaacgaagggaaaaacaacagcaataacattcatatctctggagcagctaactcatacacgtaatgtctgcttttcgtacagaactagccaatgtaaaaacagttcacctgtaaatactttttcctttttcaccgttgtattatacatgtatatgctgggtcctttttcagaaactcttttcttacctgagagttgtcttgttttctgggctgtttttaactgaggaaaaaaaa

SEQ ID NO: 69145 - DNA, 4118 bp, Homo sapiens
  misc_feature (1)..(1): n is a, c, g, or t
  misc_feature (12)..(12): n is a, c, g, or t
  misc_feature (30)..(31): n is a, c, g, or t
nattcggcacgngggggggcgcggtggggnngggccttggtcgcgtcgtgtctgctcttgtgcaccagtgcctcacggagaggctgtggtctcctctgagcctccggcctccataagacccaaaacagatgacacctcttcccagtcccccgcgccttccgaaaaggacaagccgtccagctggctgcggaccttggccggctcttccaataagagcctgggctgtgttcaccctcgccagcgcctctctgctttccgaccctggtcccccgcagtgtcagcgagtgagaaagagctctccccacacctcccggccctcatccgagacagcttctactcctacaagagctttgagacagccgtggcgcccaacgtggccctcgcaccgccggcccagcagaaggttgtgagcagccctccgtgtgccgccgccgtctcccgggcccccgagcctctcgccacttgcacccagcctcggaagcggaagctgactgtggacaccccaggagccccagagacgctggcgcccgtggctgccccagaggaggacaaggactcggaggcggaggtggaagttgaaagcagggaggaattcacctcctccttgtcctcgctctcttccccgtcctttacctcatccagctccgccaaggacctgggctccccgggtgcgcgtgccctgccctcggccgtccctgatgctgcggcccctgccgacgcccccagtgggctggaggcggagctggagcacctgcggcaggcactggagggcggcctggacaccaaggaagccaaagagaagttcctgcatgaggtggtcaagatgcgcgtgaagcaggaggagaagctcagcgcagccctgcaggccaagcgcagcctccaccaggagctggagttcctacgcgtggccaagaaggagaagctgcgggaggccacggaggccaagcgtaacctgcggaaggagatcgagcgtctccgcgccgagaacgagaagaagatgaaagaggccaacgagtcacggctgcgcctgaagcgggagctggagcaggcgcggcaggcccgggtgtgcgacaagggctgcgaggcgggccgcctgcgcgccaagtactcggcccagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttcagcgacaaggacccaggtcttcctgctgctgccagggagagcagggacagtgccgcgtgcgagatgagctcgaacactgcccgccttactgccgcctaccccgcccgccacgccgccgtcgatgccagcgctgtccccacgggtaccaggaagtgcagagccgcacaggagctgccccggagctgaggggacggtcttcggctcctctgcaccccgtgattctgcccacgctcctccaccacgaggcactgacctgcgtcgggtggtgaccgtggctggcggtcacgccctcagcccctccgggcacacgtgccgcctgaccgggcgacccttttcagttcggcaaacgtcgctcccttcattttgggactgaggctgcagcattggaacaaaagagcattatttcaatttttctttctttttttttgttcgttcatttaaacgtatatttagaactgcactttgtccacaaccttcccttctctttctattccccagtgaactgaggtttttaccgatttatagagcagtcaaatccgaagtgctcgagtgcttagaaaccccctctggtgcttggttgaacaagggaatcacaagaaaacgaaaatgcaaaaactgaacttcgggggtcgttctgtgccttccagcatcttgtacagcaaatcctgactcgtgtctttttacccccaagatatctgtcttcagtagcgactgaatctgccactctcagaataagttccttgcatttattccaaataatctcgtttactctcacctgtttatgcaaattgtataaggtttcttatgcccaagcttgaaaaatgatttcccagtagacaagaggcggctacctatcctacagttacggtatttatttacataagaagatcttacaggagttctttgcttgaatccgttctaacacccgcggcagctgcacgcgctcacagaaggtggaggttacttgcccaggtacagacgacctcggggcagtgacgagcaaagaccagagactgctgagccctcgcatctgggtggcggaattgcctgcggggttttgcccttggtttactgaggggggtcttggttgctgctgaagccccccaccccttctaaagtgcaatgcaaaagggacatcatgtatatgcagcgtttgtttggaattttctttgcttttgttttctttgcggttgttctgtgtgcatggattccacacctctgccgtaggtagatccgtcagcgggcattattaccgtgtcttgtaaaagggtcggttttgttatgcaacacgcagaatgctgtttttagccttgttttaccagagttgttttttttttcagttatttcttcaagggaaactaaatgatttagttggagcaaagctttaagtgtgttggcgtgcttctgtgtggctgtcctgtgtcgccaggtcgaagatcacagtgaggtagaggccctgccccatccccagggccgccaggcttgctccgtttgctttgagtttttagaccccagagggagatgagcttttccaagctgtgtctgggccagagcctctccttgcccttgctccatcccgacggtcaccgttgggtccacgcctccaccgccccatcttgccccaaacggaaagcgctgtatctgcagtggcagcccttccccacttcggctctgggagggtccagccagtgtcacctgggcccaccctttcctgcagctgccaggcccgtgcggtcagtgggacccggacgtgggcaggcgagctcgggaccctcccaggcagttcccacagctcttgcctcggctcaccagggtcacttccactgtcaggggcctgagggggcagctgtggctgcagggctgctctggactgaggggtcccaggccccgaggggtgcacgcctggctccccttggcacaggtgcgagtccgtttcttttcagcagaagggggaagaggtgtccgctgtgtgggctgctgactcctctgtgtgtgaggcccttcatctaagtgattgtgtattcagtttaattctcattatatttctatactgaaagaagatttttaacgaagggaaaaacaacagcaataacattcatatctctggagcagctaactcatacacgtaatgtctgcttttcgtacagaactagccaatgtaaaaacagttcacctgtaaatactttttcctttttcaccgttgtattatacatgtatatgctgggtcctttttcagaaactcttttcttacctgagagttgtcttgttttctgggctgtttttaactgaggaaaaaaaa

SEQ ID NO: 69146 - DNA, 5052 bp, Homo sapiens
cggggcggcggcgggggccgggggggcccgggcgcgcgggagcgggagcggccgggggagccggagcgcaccatggaggcggcggcaggcggccgcggctgtttccagccgcacccggggctgcagaagacgctggagcagttccacctgagctccatgagctcgctgggcggcccggccgctttctcggcgcgctgggcgcaggaggcctacaagaaggagagcgccaaggaggcgggcgcggccgcggtgccggcgccggtgcccgcagccaccgagccgccgcccgtgctgcacctgcccgccatccagccgccgccgcccgtgctgcccgggcccttcttcatgccgtccgaccgctccaccgagcgctgcgagaccgtactggaaggcgagaccatctcgtgcttcgtggtgggaggcgagaagcgcctgtgtctgccgcagattctcaactcggtgctgcgcgacttctcgctgcagcagatcaacgcggtgtgcgacgagctccacatctactgctcgcgctgcacggccgaccagctggagatcctcaaagtcatgggcatcctgcccttctcggcgccctcgtgcgggctcatcaccaagacggacgccgagcgcctgtgcaacgcgctgctctacggcggcgcctacccgccgccctgcaagaaggagctggccgccagcctggcgctgggcctggagctcagcgagcgcagcgtccgcgtgtaccacgagtgcttcggcaagtgtaaggggctgctggtgcccgagctctacagcagcccgagcgccgcctgcatccagtgcctggactgccgcctcatgtacccgccgcacaagttcgtggtgcactcgcacaaggccctggagaaccggacctgccactggggcttcgactcggccaactggcgggcctacatcctgctgagccaggattacacgggcaaggaggagcaggcgcgcctcggccgctgcctggacgacgtgaaggagaaattcgactatggcaacaagtacaagcggcgggtgccccgggtctcctctgagcctccggcctccataagacccaaaacagatgacacctcttcccagtcccccgcgccttccgaaaaggacaagccgtccagctggctgcggaccttggccggctcttccaataagagcctgggctgtgttcaccctcgccagcgcctctctgctttccgaccctggtcccccgcagtgtcagcgagtgagaaagagctctccccacacctcccggccctcatccgagacagcttctactcctacaagagctttgagacagccgtggcgcccaacgtggccctcgcaccgccggcccagcagaaggttgtgagcagccctccgtgtgccgccgccgtctcccgggcccccgagcctctcgccacttgcacccagcctcggaagcggaagctgactgtggacaccccaggagccccagagacgctggcgcccgtggctgccccagaggaggacaaggactcggaggcggaggtggaagttgaaagcagggaggaattcacctcctccttgtcctcgctctcttccccgtcctttacctcatccagctccgccaaggacctgggctccccgggtgcgcgtgccctgccctcggccgtccctgatgctgcggcccctgccgacgcccccagtgggctggaggcggagctggagcacctgcggcaggcactggagggcggcctggacaccaaggaagccaaagagaagttcctgcatgaggtggtcaagatgcgcgtgaagcaggaggagaagctcagcgcagccctgcaggccaagcgcagcctccaccaggagctggagttcctacgcgtggccaagaaggagaagctgcgggaggccacggaggccaagcgtaacctgcggaaggagatcgagcgtctccgcgccgagaacgagaagaagatgaaagaggccaacgagtcacggctgcgcctgaagcgggagctggagcaggcgcggcaggcccgggtgtgcgacaagggctgcgaggcgggccgcctgcgcgccaagtactcggcccagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttagcgacaaggacccaggtcttcctgctgctgccagggagagcagggacagtgccgcgtgcgagatgagctcgaacactgcccgccttactgccgcctaccccgcccgccacgccgccgtcgatgccagcgctgtccccacgggtaccaggaagtgcagagccgcacaggagctgccccggagctgaggggacggtcttcggctcctctgcaccccgtgattctgcccacgctcctccaccacgaggcactgacctgcgtcgggtggtgaccgtggctggcggtcacgccctcagcccctccgggcacacgtgccgcctgaccgggcgacccttttcagttcggcaaacgtcgctcccttcattttgggactgaggctgcagcattggaacaaaagagcattatttcaatttttctttctttttttttgttcgttcatttaaacgtatatttagaactgcactttgtccacaaccttcccttctctttctattccccagtgaactgaggtttttaccgatttatagagcagtcaaatccgaagtgctcgagtgcttagaaaccccctctggtgcttggttgaacaagggaatcacaagaaaacgaaaatgcaaaaactgaacttcgggggtcgttctgtgccttccagcatcttgtacagcaaatcctgactcgtgtctttttacccccaagatatctgtcttcagtagcgactgaatctgccactctcagaataagttccttgcatttattccaaataatctcgtttactctcacctgtttatgcaaattgtataaggtttcttatgcccaagcttgaaaaatgatttcccagtagacaagaggcggctacctatcctacagttacggtatttatttacataagaagatcttacaggagttctttgcttgaatccgttctaacacccgcggcagctgcacgcgctcacagaaggtggaggttacttgcccaggtacagacgacctcggggcagtgacgagcaaagaccagagactgctgagccctcgcatctgggtggcggaattgcctgcggggttttgcccttggtttactgaggggggtcttggttgctgctgaagccccccaccccttctaaagtgcaatgcaaaagggacatcatgtatatgcagcgtttgtttggaattttctttgcttttgttttctttgcggttgttctgtgtgcatggattccacacctctgccgtaggtagatccgtcagcgggcattattaccgtgtcttgtaaaagggtcggttttgttatgcaacacgcagaatgctgtttttagccttgttttaccagagttgttttttttttcagttatttcttcaagggaaactaaatgatttagttggagcaaagctttaagtgtgttggcgtgcttctgtgtggctgtcctgtgtcgccaggtcgaagatcacagtgaggtagaggccctgccccatccccagggccgccaggcttgctccgtttgctttgagtttttagaccccagagggagatgagcttttccaagctgtgtctgggccagagcctctccttgcccttgctccatcccgacggtcaccgttgggtccacgcctccaccgccccatcttgccccaaacggaaagcgctgtatctgcagtggcagcccttccccacttcggctctgggagggtccagccagtgtcacctgggcccaccctttcctgcagctgccaggcccgtgcggtcagtgggacccggacgtgggcaggcgagctcgggaccctcccaggcagttcccacagctcttgcctcggctcaccagggtcacttccactgtcaggggcctgagggggcagctgtggctgcagggctgctctggactgaggggtcccaggccccgaggggtgcacgcctggctccccttggcacaggtgcgagtccgtttcttttcagcagaagggggaagaggtgtccgctgtgtgggctgctgactcctctgtgtgtgaggcccttcatctaagtgattgtgtattcagtttaattctcattatatttctatactgaaagaagatttttaacgaagggaaaaacaacagcaataacattcatatctctggagcagctaactcatacacgtaatgtctgcttttcgtacagaactagccaatgtaaaaacagttcacctgtaaatactttttcctttttcaccgttgtattatacatgtatatgctgggtcctttttcagaaactcttttcttacctgagagttgtcttgttttctgggctgtttttaactgaggaaaaaaaa

SEQ ID NO: 69147 - DNA, 1567 bp, Homo sapiens
acctatacggctaggtacgaggctgcgtgttagttactctcacctgtttatgcaaattgtataaggtttcttatgcccaagcttgaaaaatgatttcccagtagacaagaggcggctacctatcctacagttacggtatttatttacataagaagatcttacaggagttctttgcttgaatccgttctaacacccgcggcagctgcacgcgctcacagaaggtggaggttacttgcccaggtacagacgacctcggggcagtgacgagcaaagaccagagactgctgagccctcgcatctgggtggcggaattgcctgcggggttttgcccttggtttactgaggggggtcttggttgctgctgaagccccccaccccttctaaagtgcaatgcaaaagggacatcatgtatatgcagcgtttgtttggaattttctttgcttttgttttctttgcggttgttctgtgtgcatggattccacacctctgccgtaggtagatccgtcagcgggcattattaccgtgtcttgtaaaagggtcggttttgttatgcaacacgcagaatgctgtttttagccttgttttaccagagttgttttttttttcagttatttcttcaagggaaactaaatgatttagttggagcaaagctttaagtgtgttggcgtgcttctgtgtggctgtcctgtgtcgccaggtcgaagatcacagtgaggtagaggccctgccccatccccagggccgccaggcttgctccgtttgctttgagtttttagaccccagagggagatgagcttttccaagctgtgtctgggccagagcctctccttgcccttgctccatcccgacggtcaccgttgggtccacgcctccaccgccccatcttgccccaaacggaaagcgctgtatctgcagtggcagcccttccccacttcggctctgggagggtccagccagtgtcacctgggcccaccctttcctgcagctgccaggcccgtgcggtcagtgggacccggacgtgggcaggcgagctcgggaccctcccaggcagttcccacagctcttgcctcggctcaccagggtcacttccactgtcaggggcctgagggggcagctgtggctgcagggctgctctggactgaggggtcccaggccccgaggggtgcacgcctggctccccttggcacaggtgcgagtccgtttcttttcagcagaagggggaagaggtgtccgctgtgtgggctgctgactcctctgtgtgtgaggcccttcatctaagtgattgtgtattcagtttaattctcattatatttctatactgaaagaagatttttaacgaagggaaaaacaacagcaataacattcatatctctggagcagctaactcatacacgtaatgtctgcttttcgtacagaactagccaatgtaaaaacagttcacctgtaaatactttttcctttttcaccgttgtattatacatgtatatgctgggtcctttttcagaaactcttttcttacctgagagttgtcttgttttctgggctgtttttaactgaggaaaaaaaa

SEQ ID NO: 69148 - DNA, 3110 bp, Homo sapiens
cggggcggcggcgggggccgggggggcccgggcgcgcgggagcgggagcggccgggggagccggagcgcaccatggaggcggcggcaggcggccgcggctgtttccagccgcacccggggctgcagaagacgctggagcagttccacctgagctccatgagctcgctgggcggcccggccgctttctcggcgcgctgggcgcaggaggcctacaagaaggagagcgccaaggaggcgggcgcggccgcggtgccggcgccggtgcccgcagccaccgagccgccgcccgtgctgcacctgcccgccatccagccgccgccgcccgtgctgcccgggcccttcttcatgccgtccgaccgctccaccgagcgctgcgagaccgtactggaaggcgagaccatctcgtgcttcgtggtgggaggcgagaagcgcctgtgtctgccgcagattctcaactcggtgctgcgcgacttctcgctgcagcagatcaacgcggtgtgcgacgagctccacatctactgctcgcgctgcacggccgaccagctggagatcctcaaagtcatgggcatcctgcccttctcggcgccctcgtgcgggctcatcaccaagacggacgccgagcgcctgtgcaacgcgctgctctacggcggcgcctacccgccgccctgcaagaaggagctggccgccagcctggcgctgggcctggagctcagcgagcgcagcgtccgcgtgtaccacgagtgcttcggcaagtgtaaggggctgctggtgcccgagctctacagcagcccgagcgccgcctgcatccagtgcctggactgccgcctcatgtacccgccgcacaagttcgtggtgcactcgcacaaggccctggagaaccggacctgccactggggcttcgactcggccaactggcgggcctacatcctgctgagccaggattacacgggcaaggaggagcaggcgcgcctcggccgctgcctggacgacgtgaaggagaaattcgactatggcaacaagtacaagcggcgggtgccccgggtctcctctgagcctccggcctccataagacccaaaacagatgacacctcttcccagtcccccgcgccttccgaaaaggacaagccgtccagctggctgcggaccttggccggctcttccaataagagcctgggctgtgttcaccctcgccagcgcctctctgctttccgaccctggtcccccgcagtgtcagcgagtgagaaagagctctccccacacctcccggccctcatccgagacagcttctactcctacaagagctttgagacagccgtggcgcccaacgtggccctcgcaccgccggcccagcagaaggttgtgagcagccctccgtgtgccgccgccgtctcccgggcccccgagcctctcgccacttgcacccagcctcggaagcggaagctgactgtggacaccccaggagccccagagacgctggcgcccgtggctgccccagaggaggacaaggactcggaggcggaggtggaagttgaaagcagggaggaattcacctcctccttgtcctcgctctcttccccgtcctttacctcatccagctccgccaaggacctgggctccccgggtgcgcgtgccctgccctcggccgtccctgatgctgcggcccctgccgacgcccccagtgggctggaggcggagctggagcacctgcggcaggcactggagggcggcctggacaccaaggaagccaaagagaagttcctgcatgaggtggtcaagatgcgcgtgaagcaggaggagaagctcagcgcagccctgcaggccaagcgcagcctccaccaggagctggagttcctacgcgtggccaagaaggagaagctgcgggaggccacggaggccaagcgtaacctgcggaaggagatcgagcgtctccgcgccgagaacgagaagaagatgaaagaggccaacgagtcacggctgcgcctgaagcgggagctggagcaggcgcggcaggcccgggtgtgcgacaagggctgcgaggcgggccgcctgcgcgccaagtactcggcccagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttccccaccagggtccagggagatgttcgttctcgctttaagtcaggagtcacaaatgactttttttttttcaattaaggaaaaagctccatctctacctttaacatcacccagacccccgcccctgcccgtgccccacgctgctgctaacgacagtatgatgcttactctgctactcggaaactatttttatgtaattaatgtatgctttcttgtttataaatgcctgatttaaaaagaaaagagcttggcatatttatctatttcgctgtgtacctgttagtccttccccgaccccgaaacagatgacattgtacaataaaggactttgagaggaaagc

SEQ ID NO: 69149 - DNA, 3240 bp, Homo sapiens
  misc_feature (3145)..(3145): n is a, c, g, or t
cggggcggcggcgggggccgggggggcccgggcgcgcgggagcgggagcggccgggggagccggagcgcaccatggaggcggcggcaggcggccgcggctgtttccagccgcacccggggctgcagaagacgctggagcagttccacctgagctccatgagctcgctgggcggcccggccgctttctcggcgcgctgggcgcaggaggcctacaagaaggagagcgccaaggaggcgggcgcggccgcggtgccggcgccggtgcccgcagccaccgagccgccgcccgtgctgcacctgcccgccatccagccgccgccgcccgtgctgcccgggcccttcttcatgccgtccgaccgctccaccgagcgctgcgagaccgtactggaaggcgagaccatctcgtgcttcgtggtgggaggcgagaagcgcctgtgtctgccgcagattctcaactcggtgctgcgcgacttctcgctgcagcagatcaacgcggtgtgcgacgagctccacatctactgctcgcgctgcacggccgaccagctggagatcctcaaagtcatgggcatcctgcccttctcggcgccctcgtgcgggctcatcaccaagacggacgccgagcgcctgtgcaacgcgctgctctacggcggcgcctacccgccgccctgcaagaaggagctggccgccagcctggcgctgggcctggagctcagcgagcgcagcgtccgcgtgtaccacgagtgcttcggcaagtgtaaggggctgctggtgcccgagctctacagcagcccgagcgccgcctgcatccagtgcctggactgccgcctcatgtacccgccgcacaagttcgtggtgcactcgcacaaggccctggagaaccggacctgccactggggcttcgactcggccaactggcgggcctacatcctgctgagccaggattacacgggcaaggaggagcaggcgcgcctcggccgctgcctggacgacgtgaaggagaaattcgactatggcaacaagtacaagcggcgggtgccccgggtctcctctgagcctccggcctccataagacccaaaacagatgacacctcttcccagtcccccgcgccttccgaaaaggacaagccgtccagctggctgcggaccttggccggctcttccaataagagcctgggctgtgttcaccctcgccagcgcctctctgctttccgaccctggtcccccgcagtgtcagcgagtgagaaagagctctccccacacctcccggccctcatccgagacagcttctactcctacaagagctttgagacagccgtggcgcccaacgtggccctcgcaccgccggcccagcagaaggttgtgagcagccctccgtgtgccgccgccgtctcccgggcccccgagcctctcgccacttgcacccagcctcggaagcggaagctgactgtggacaccccaggagccccagagacgctggcgcccgtggctgccccagaggaggacaaggactcggaggcggaggtggaagttgaaagcagggaggaattcacctcctccttgtcctcgctctcttccccgtcctttacctcatccagctccgccaaggacctgggctccccgggtgcgcgtgccctgccctcggccgtccctgatgctgcggcccctgccgacgcccccagtgggctggaggcggagctggagcacctgcggcaggcactggagggcggcctggacaccaaggaagccaaagagaagttcctgcatgaggtggtcaagatgcgcgtgaagcaggaggagaagctcagcgcagccctgcaggccaagcgcagcctccaccaggagctggagttcctacgcgtggccaagaaggagaagctgcgggaggccacggaggccaagcgtaacctgcggaaggagatcgagcgtctccgcgccgagaacgagaagaagatgaaagaggccaacgagtcacggctgcgcctgaagcgggagctggagcaggcgcggcaggcccgggtgtgcgacaagggctgcgaggcgggccgcctgcgcgccaagtactcggcccagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttcagcgacaaggacccaggtcttcctgctgctgccagggagagcagggacagtgccgcgtgcgagatgagctcgaacactgcccgccttactgccgcctaccccgcccgccacgccgccgtcgatgccagcgctgtccccacgggtaccaggaagtgcagagccgcacaggagctgccccggagctgagggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttntggaacccactgcaaaattttctactggccaagttcaagtgagtaagccgcgtcccccaactacacctgagccgcaaaacgtcgggagctattcc

SEQ ID NO: 69150 - DNA, 3003 bp, Homo sapiens
cggggcggcggcgggggccgggggggcccgggcgcgcgggagcgggagcggccgggggagccggagcgcaccatggaggcggcggcaggcggccgcggctgtttccagccgcacccggggctgcagaagacgctggagcagttccacctgagctccatgagctcgctgggcggcccggccgctttctcggcgcgctgggcgcaggaggcctacaagaaggagagcgccaaggaggcgggcgcggccgcggtgccggcgccggtgcccgcagccaccgagccgccgcccgtgctgcacctgcccgccatccagccgccgccgcccgtgctgcccgggcccttcttcatgccgtccgaccgctccaccgagcgctgcgagaccgtactggaaggcgagaccatctcgtgcttcgtggtgggaggcgagaagcgcctgtgtctgccgcagattctcaactcggtgctgcgcgacttctcgctgcagcagatcaacgcggtgtgcgacgagctccacatctactgctcgcgctgcacggccgaccagctggagatcctcaaagtcatgggcatcctgcccttctcggcgccctcgtgcgggctcatcaccaagacggacgccgagcgcctgtgcaacgcgctgctctacggcggcgcctacccgccgccctgcaagaaggagctggccgccagcctggcgctgggcctggagctcagcgagcgcagcgtccgcgtgtaccacgagtgcttcggcaagtgtaaggggctgctggtgcccgagctctacagcagcccgagcgccgcctgcatccagtgcctggactgccgcctcatgtacccgccgcacaagttcgtggtgcactcgcacaaggccctggagaaccggacctgccactggggcttcgactcggccaactggcgggcctacatcctgctgagccaggattacacgggcaaggaggagcaggcgcgcctcggccgctgcctggacgacgtgaaggagaaattcgactatggcaacaagtacaagcggcgggtgccccgggtctcctctgagcctccggcctccataagacccaaaacagatgacacctcttcccagtcccccgcgccttccgaaaaggacaagccgtccagctggctgcggaccttggccggctcttccaataagagcctgggctgtgttcaccctcgccagcgcctctctgctttccgaccctggtcccccgcagtgtcagcgagtgagaaagagctctccccacacctcccggccctcatccgagacagcttctactcctacaagagctttgagacagccgtggcgcccaacgtggccctcgcaccgccggcccagcagaaggttgtgagcagccctccgtgtgccgccgccgtctcccgggcccccgagcctctcgccacttgcacccagcctcggaagcggaagctgactgtggacaccccaggagccccagagacgctggcgcccgtggctgccccagaggaggacaaggactcggaggcggaggtggaagttgaaagcagggaggaattcacctcctccttgtcctcgctctcttccccgtcctttacctcatccagctccgccaaggacctgggctccccgggtgcgcgtgccctgccctcggccgtccctgatgctgcggcccctgccgacgcccccagtgggctggaggcggagctggagcacctgcggcaggcactggagggcggcctggacaccaaggaagccaaagagaagttcctgcatgaggtggtcaagatgcgcgtgaagcaggaggagaagctcagcgcagccctgcaggccaagcgcagcctccaccaggagctggagttcctacgcgtggccaagaaggagaagctgcgggaggccacggaggccaagcgtaacctgcggaaggagatcgagcgtctccgcgccgagaacgagaagaagatgaaagaggccaacgagtcacggctgcgcctgaagcgggagctggagcaggcgcggcaggcccgggtgtgcgacaagggctgcgaggcgggccgcctgcgcgccaagtactcggcccagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttccccaccagggtccagggagatgttcgttctcgctttaagtcaggagtcacaaatgactttttttttttcaattaaggaaaaagctccatctctacctttaacatcacccagacccccgcccctgcccgtgccccacgctgctgctaacgacagtatgatgcttactctgctactcggaaactatttttatgtaattaatgtatgctttcttgtttataaatgcctgattta

SEQ ID NO: 69151 - DNA, 633 bp, Homo sapiens
  misc_feature (26)..(26): n is a, c, g, or t
ttattgtgtaataagtttgttgcttncctagaaattagttgaagcctgcagctgccaggcccgtgcggtcagtgggacccggacgtgggcaggcgagctcgggaccctcccaggcagttcccacagctcttgcctcggctcaccagggtcacttccactgtcaggggcctgagggggcagctgtggctgcagggctgctctggactgaggggtcccaggccccgaggggtgcacgcctggctccccttggcacaggtgcgagtccgtttcttttcagcagaagggggaagaggtgtccgctgtgtgggctgctgactcctctgtgtgtgaggcccttcatctaagtgattgtgtattcagtttaattctcattatatttctatactgaaagaagatttttaacgaagggaaaaacaacagcaataacattcatatctctggagcagctaactcatacacgtaatgtctgcttttcgtacagaactagccaatgtaaaaacagttcacctgtaaatactttttcctttttcaccgttgtattatacatgtatatgctgggtcctttttcagaaactcttttcttacctgagagttgtcttgttttctgggctgtttttaactgaggaaaaaaaa

SEQ ID NO: 69152 - DNA, 530 bp, Homo sapiens
  misc_feature (22)..(22): n is a, c, g, or t
  misc_feature (61)..(61): n is a, c, g, or t
  misc_feature (101)..(101): n is a, c, g, or t
ttcctcggcctcccccttcccngcttcccaggcattgcccagctacccccactctttcccncccccaacaagcctctctgtctccaatcagccccccagtnaactcgccttctctcccatcccaggctgtgtggagccagggtcccctcctccctgtgggtccgaaccccggcccccccacccctccctcagcccaccagggtccagggagatgttcgttctcgctttaagtcaggagtcacaaatgactttttttttttcaattaaggaaaaagctccatctctacctttaacatcacccagacccccgcccctgcccgtgccccacgctgctgctaacgacagtatgatgcttactctgctactcggaaactatttttatgtaattaatgtatgctttcttgtttataaatgcctgatttaaaaagaaaagagcttggcatatttatctatttcgctgtgtacctgttagtccttccccgaccccgaaacagatgacattgtacaataaaggactttgagaggaaagc

SEQ ID NO: 69153 - DNA, 5071 bp, Homo sapiens
cggggcggcggcgggggccgggggggcccgggcgcgcgggagcgggagcggccgggggagccggagcgcaccatggaggcggcggcaggcggccgcggctgtttccagccgcacccggggctgcagaagacgctggagcagttccacctgagctccatgagctcgctgggcggcccggccgctttctcggcgcgctgggcgcaggaggcctacaagaaggagagcgccaaggaggcgggcgcggccgcggtgccggcgccggtgcccgcagccaccgagccgccgcccgtgctgcacctgcccgccatccagccgccgccgcccgtgctgcccgggcccttcttcatgccgtccgaccgctccaccgagcgctgcgagaccgtactggaaggcgagaccatctcgtgcttcgtggtgggaggcgagaagcgcctgtgtctgccgcagattctcaactcggtgctgcgcgacttctcgctgcagcagatcaacgcggtgtgcgacgagctccacatctactgctcgcgctgcacggccgaccagctggagatcctcaaagtcatgggcatcctgcccttctcggcgccctcgtgcgggctcatcaccaagacggacgccgagcgcctgtgcaacgcgctgctctacggcggcgcctacccgccgccctgcaagaaggagctggccgccagcctggcgctgggcctggagctcagcgagcgcagcgtccgcgtgtaccacgagtgcttcggcaagtgtaaggggctgctggtgcccgagctctacagcagcccgagcgccgcctgcatccagtgcctggactgccgcctcatgtacccgccgcacaagttcgtggtgcactcgcacaaggccctggagaaccggacctgccactggggcttcgactcggccaactggcgggcctacatcctgctgagccaggattacacgggcaaggaggagcaggcgcgcctcggccgctgcctggacgacgtgaaggagaaattcgactatggcaacaagtacaagcggcgggtgccccgggtctcctctgagcctccggcctccataagacccaaaacagatgacacctcttcccagtcccccgcgccttccgaaaaggacaagccgtccagctggctgcggaccttggccggctcttccaataagagcctgggctgtgttcaccctcgccagcgcctctctgctttccgaccctggtcccccgcagtgtcagcgagtgagaaagagctctccccacacctcccggccctcatccgagacagcttctactcctacaagagctttgagacagccgtggcgcccaacgtggccctcgcaccgccggcccagcagaaggttgtgagcagccctccgtgtgccgccgccgtctcccgggcccccgagcctctcgccacttgcacccagcctcggaagcggaagctgactgtggacaccccaggagccccagagacgctggcgcccgtggctgccccagaggaggacaaggactcggaggcggaggtggaagttgaaagcagggaggaattcacctcctccttgtcctcgctctcttccccgtcctttacctcatccagctccgccaaggacctgggctccccgggtgcgcgtgccctgccctcggccgtccctgatgctgcggcccctgccgacgcccccagtgggctggaggcggagctggagcacctgcggcaggcactggagggcggcctggacaccaaggaagccaaagagaagttcctgcatgaggtggtcaagatgcgcgtgaagcaggaggagaagctcagcgcagccctgcaggccaagcgcagcctccaccaggagctggagttcctacgcgtggccaagaaggagaagctgcgggaggccacggaggccaagcgtaacctgcggaaggagatcgagcgtctccgcgccgagaacgagaagaagatgaaagaggccaacgagtcacggctgcgcctgaagcgggagctggagcaggcgcggcaggcccgggtgtgcgacaagggctgcgaggcgggccgcctgcgcgccaagtactcggcccagatcgaagacctgcaggtgaagctgcagcacgcggaggcggaccgggagcagctgcgggccgacctgctgcgggagcgcgaggcccgggagcacctggagaaggtggtgaaggagctgcaggaacagctgtggccgcgggcccgccccgaggctgcgggcagcgagggcgctgcggagctggagccgtagattccgtgcctgccgccgcagcgccgccgacaacgcgggtgcaggggggcgcggctgggcggtgcagctccgcccggctccgcccctgcagcccacacagcacaacgtcttaccgtgcctattaccaagcgagtgtttgtaaccatgtagttttggaacccactgcaaaattttctactggccaagttcaagtgagtaagccgcgtcccccaactacagctggagacggggccagctcggcggcctgctggtcctctgcttgctggaacattctaacatttacacttttgttataagctatttaaaaccagtaaggagacttgaaattcagaaaatcaacacatttttaaatgactaacttctaaaagccccaacacatgacgccatctgaagacccgcaacggagtgggggtggcggccgccccaccctccccacccggggaagccatcacagctcatctgcccgcggctgcgtgaggacagcaggggtttttcttcagagtctattttttcagcgacaaggacccaggtcttcctgctgctgccagggagagcagggacagtgccgcgtgcgagatgagctcgaacactgcccgccttactgccgcctaccccgcccgccacgccgccgtcgatgccagcgctgtccccacgggtaccaggaagtgcagagccgcacaggagctgccccggagctgaggggacggtcttcggctcctctgcaccccgtgattctgcccacgctcctccaccacgaggcactgacctgcgtcgggtggtgaccgtggctggcggtcacgccctcagcccctccgggcacacgtgccgcctgaccgggcgacccttttcagttcggcaaacgtcgctcccttcattttgggactgaggctgcagcattggaacaaaagagcattatttcaatttttctttctttttttttgttcgttcatttaaacgtatatttagaactgcactttgtccacaaccttcccttctctttctattccccagtgaactgaggtttttaccgatttatagagcagtcaaatccgaagtgctcgagtgcttagaaaccccctctggtgcttggttgaacaagggaatcacaagaaaacgaaaatgcaaaaactgaacttcgggggtcgttctgtgccttccagcatcttgtacagcaaatcctgactcgtgtctttttacccccaagatatctgtcttcagtagcgactgaatctgccactctcagaataagttccttgcatttattccaaataatctcgtttactctcacctgtttatgcaaattgtataaggtttcttatgcccaagcttgaaaaatgatttcccagtagacaagaggcggctacctatcctacagttacggtatttatttacataagaagatcttacaggagttctttgcttgaatccgttctaacacccgcggcagctgcacgcgctcacagaaggtggaggttacttgcccaggtacagacgacctcggggcagtgacgagcaaagaccagagactgctgagccctcgcatctgggtggcggaattgcctgcggggttttgcccttggtttactgaggggggtcttggttgctgctgaagccccccaccccttctaaagtgcaatgcaaaagggacatcatgtatatgcagcgtttgtttggaattttctttgcttttgttttctttgcggttgttctgtgtgcatggattccacacctctgccgtaggtagatccgtcagcgggcattattaccgtgtcttgtaaaagggtcggttttgttatgcaacacgcagaatgctgtttttagccttgttttaccagagttgttttttttttcagttatttcttcaagggaaactaaatgatttagttggagcaaagctttaagtgtgttggcgtgcttctgtgtggctgtcctgtgtcgccaggtcgaagatcacagtgaggtagaggccctgccccatccccagggccgccaggcttgctccgtttgctttgagtttttagaccccagagggagatgagcttttccaagctgtgtctgggccagagcctctccttgcccttgctccatcccgacggtcaccgttgggtccacgcctccaccgccccatcttgccccaaacggaaagcgctgtatctgcagtggcagcccttccccacttcggctctgggagggtccagccagtgtcacctgggcccaccctttcctgcagctgccaggcccgtgcggtcagtgggacccggacgtgggcaggcgagctcgggaccctcccaggcagttcccacagctcttgcctcggctcaccagggtcacttccactgtcaggggcctgagggggcagctgtggctgcagggctgctctggactgaggggtcccaggccccgaggggtgcacgcctggctccccttggcacaggtgcgagtccgtttcttttcagcagaagggggaagaggtgtccgctgtgtgggctgctgactcctctgtgtgtgaggcccttcatctaagtgattgtgtattcagtttaattctcattatatttctatactgaaagaagatttttaacgaagggaaaaacaacagcaataacattcatatctctggagcagctaactcatacacgtaatgtctgcttttcgtacagaactagccaatgtaaaaacagttcacctgtaaatactttttcctttttcaccgttgtattatacatgtatatgctgggtcctttttcagaaactcttttcttacctgagagttgtcttgttttctgggctgtttttaactgaggaaaaaaaa

SEQ ID NO: 69154 - DNA, 5216 bp, Homo sapiens
  misc_feature (1)..(1): n is a, c, g, or t
  misc_feature (4)..(5): n is a, c, g, or t
  misc_feature (10)..(12): n is a, c, g, or t
  misc_feature (16)..(17): n is a, c, g, or t
  misc_feature (22)..(22): n is a, c, g, or t
  misc_feature (25)..(26): n is a, c, g, or t
  misc_feature (31)..(31): n is a, c, g, or t
  misc_feature (34)..(34): n is a, c, g, or t
  misc_feature (37)..(37): n is a, c, g, or t
  misc_feature (40)..(41): n is a, c, g, or t
  misc_feature (44)..(44): n is a, c, g, or t
  misc_feature (51)..(51): n is a, c, g, or t
  misc_feature (69)..(70): n is a, c, g, or t
  misc_feature (76)..(76): n is a, c, g, or t
  misc_feature (78)..(78): n is a, c, g, or t
  misc_feature (82)..(82): n is a, c, g, or t
  misc_feature (88)..(88): n is a, c, g, or t
ngannctgannnatgnnaaganctnnaacancangangcnnagntgcaggnccgcccgaggcgttggannagactngngagngccgcngggcgcggaggaggaggatctgggggaagaggaggaggagggccgatcgtcctgggcccgaggaaaagagagaagaaggggacacggagcctctcctgaaacaagaggggccggtggaagccgcgcagcctccggtggagaggaaagaagccgccgcccttgaacaaggccgcaaggtggaggagctgcggtggcaggaggtggacgagagacagaccatgccccggccctacacgttccaggtgtcctccggagggaagcagattctctttcccaaagtcaacctgagccccgtgacgcccgcaaaggacacggggctcaccgctgctccccaggaaccaaaggcccccaaagccagcccagtccagcacgccctaccgtcgtccctgagcgttccccacaccgccattctggtcacgggcgcgcagctctgtggcccggcagtcaacctgagccagatcaaggacaccgcgtgcaagtccctcctgggcttggaggagaagaagcacgcggaagccccagctggggagaaccctccccgaggccccggcgacgcgagggcgggcagcgggaaggctaagcccccccaggagtctcccagcagcgcgtccgcactcgcagaatgggcttccattcggtccagaatcctgaagaacgcagagagtgacccgcgcagcagcgagagggaccagttgaggcccggtgatgagtccactcccaggggccggtgtgattcccgcgggaaccaacggaagactccgccagtcaatgcaaagttctctattatgcctgcctggcagaaattttccgatggtggcacggagacctccaaacagagcacggaagctgaaagcatacgaaaaagacccatgctgggacccagcgaagagacagccccccagcctcctcctgctggtgttcgcgagctcgggaagggtccggagaagtcggagatgcaccgggagcccgcagacaccaccgagggatgcaaatttgccaaagacctcccgtctttccttgtcccaagccttccttaccctccgcagaaagtggtggcccacacagagttcacgacctcgtcggacagcgagactgcaaacgggatagcaaagccagaccctgtgatgccaggtggagaggaaaaagcctcaccgtttggaataaaattgagaaggaccaactattccttgcgcttcaactgcgaccaacaggcagaacagaagaagaagaagaggcacagcagcaccggagacagcgcggatgcagggccgcctgcagcggggagcgctcgtggagagaaagagatggagggtgtggccctcaagcatggtccatccctcccccaagagcggaagcaagccccttccacccggagggactccgctgaaccttccagcagccgctctgttcctgtggcccaccctgggcctccaccggccagcagccagaccccggctccggagcacgacaaggcagcaaacaaaatgccactggcacaaaagccagcactggctcccaagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaatgtcagtgtcagcgtgcagcctggaagcagcagtgtcagcagagcaggttccctgcacaagtccactgctctgccagaagagaagagacccgagactgcagtgtccaggcttgagcgcagagaacagctgaaaaaggccaatactcttcctacgtctgtgacagtggagatctccgactcggctcccccagcgccgctggtaaaagaagtcaccaagaggttttccaccccggatgctgcccccgtgtcaacagaaccagcctggctggctttggccaaaaggaaagcaaaggcttggagcgactgtccacagattattaagtaaagagtgactctcacccatccctactgccagttattggctcctctcttgccctttttatttatttattttttatatggggtaaagaaatcaagctagggaaaagaagcatgttttataggctccaaaataatgtttagaaactgaactggtggtgttcattgtaaagagtggatttgcacaaccctaggtcctggtgcctcgagctcctcctagttctcaagagaaaattccgtccacaggaccacatgaagcaaaatctctaagctaagaactcgtgagagcctgccatgcccatttcatggccttgcacacacacccacccacacaccattcagaacatgtacttttgccaacctttggtaatggttttttgattctatgcactaattttctttgtccaaaacatttactctaccatatgtctgggaatgtttatcctttctacagtaatggtgaaaggatcatatctagctaaaagcaagaacacccattctcctgaatgcagtgagtaattgggaatcacaaggaacattctggcacccaactgtgcccatcttagttttcatgagttttccccactctgaagctgtaacccagaaggcacatccattcacatttttaccgcactgtggattcatagtgtggggccctgttattccaataccctccttaaggacatgtgaagcatttggcccagttggctcccagggaacattttaatttaatgtagtgaagaaagaccattctagatcagagctacaagttcactttctgtctctgagaatctccatctagggcagtagttcttatgatgtgtaggctccctcctagggcctactcaatcagagcctgtggggactgggccaggaatatgtattctggcaaaaactcttcaggtcagttctgatagatcccaaaggttaagaactgtgagaaacactgatcctaatgcaatctagtttttcagacttcgaaggggaggctcattcactcaaaaagcaacagtgagacaggaaaaataataaaacaaccccccaagccagccatttattacaagaagcaacaggttattgacattacatgtttgaaaattccctttggtctttagggaaaataaacaggaagccaagatttggagcctttgtaataaggacttcctgcagaaagtcttttctttactataattgagtaattcatatttagagtcacatgtccagtagcatttctaattttgagcattcaccttgctacctttaaaaaacatctgagttttaagtggcctttttatcatcatacacatgtgcatacaaagaagggacttggcagtttaaaagccacatatattcacttttattgccctaaatttacatgaaacagacatactggcaaactcacatattgctggtgctaaccttatatttcatagtgttggcatattccccttttcttagattcttactccgaaatataggtacacatcctttgctctgtgcagagggaattacatcctttttcctctcctacaaaaacatgctttattaagtatccatcattactttcctttatgctcgctcaatatgcaatgtgctgttattctaccatgtaccttaaataaaggatgatggcaaagttatttaccatgtagaaaccattttctttctagaaacaatagctcagcctcactgtagcagctggcatgtgtggtcaagtggatagttgtactcttgcaagttggatttaatatcatatatactggaccttcagactgttaaaaatcaatgtaacctttttttattgctatggcaagcaattagtatttcactgcacgtcttccatactaatgttcatttctaaatcttatatgtaggcatttgttagttccaatgatttcctcactaatataacactttttaatgggaatctttccacctacagccctggaatgataatgctacagtaattcttctgaattgactttttctttcatcctgtcagctttggacaatatcccaattatggcagggaacaggtggggaactaagatcagttacaaaaagttgtagatgtgtcaactttgtattggctgggatatcactgtgcccaaacaaaacaggcgaaatacctcagttaaaatttttccatcaaagtctttaaaagaagagtatactgaagaaagggcagtcacaatacttacttctaacagcttctaaagggtacatgtttaacatttcatttcaaaatcaccccaaatttgcactaaataccaatgaagtgttattttgctttagtagtcttctgagcaacaaactatggggaattctgtaaaaacatataaaaagttcaagactttttttttaaatgaatgattactatgttaaatgcaaactttttttttttttatttaaacaaacatacacttctcctggcaaggttatagatgattaacctctgttcatagacttatatataaaactagagggttttttgtttacttttttaatttttcaagtgcaattgtttcttacacagacattattactattaaattatcatttagccagttatctgcaaatatatagtatgtattgtctcttcttgtgacgtttagtttaattgcttattttaaagcagaaacattagttacaagtgtcttacaatatttttaccaacagtaaagtagagacttaatgaaaataccttagtgtgattttaatataatttgcatattttagttgtataaagttttaatgtaaaatgtccattattgaagggaaaagatctttcaataaaaaatacccacgaga

SEQ ID NO: 69155 - DNA, 4242 bp, Homo sapiens
  misc_feature (1)..(1): n is a, c, g, or t
  misc_feature (4)..(5): n is a, c, g, or t
  misc_feature (10)..(12): n is a, c, g, or t
  misc_feature (16)..(17): n is a, c, g, or t
  misc_feature (22)..(22): n is a, c, g, or t
  misc_feature (25)..(26): n is a, c, g, or t
  misc_feature (31)..(31): n is a, c, g, or t
  misc_feature (34)..(34): n is a, c, g, or t
  misc_feature (37)..(37): n is a, c, g, or t
  misc_feature (40)..(41): n is a, c, g, or t
  misc_feature (44)..(44): n is a, c, g, or t
  misc_feature (51)..(51): n is a, c, g, or t
  misc_feature (69)..(70): n is a, c, g, or t
  misc_feature (76)..(76): n is a, c, g, or t
  misc_feature (78)..(78): n is a, c, g, or t
  misc_feature (82)..(82): n is a, c, g, or t
  misc_feature (88)..(88): n is a, c, g, or t
  misc_feature (279)..(280): n is a, c, g, or t
ngannctgannnatgnnaaganctnnaacancangangcnnagntgcaggnccgcccgaggcgttggannagactngngagngccgcngggcgcggaggaggaggatctgggggaagaggaggaggagggccaggcgcacctggaggactggagggggcagctcagtgagcttctgaacgactttgaggagaggctcgaagaccaggaacgcctgaaacccgaaggacaaagagaacactccgaggagccaggtatttgcgaggagcagaacccagagnncgagcggcgaagagagcagcagggaaggagcggggatttccagggggccgatcgtcctgggcccgaggaaaagagagaagaaggggacacggagcctctcctgaaacaagaggggccggtggaagccgcgcagcctccggtggagaggaaagaagccgccgcccttgaacaaggccgcaaggtggaggagctgcggtggcaggaggtggacgagagacagaccatgccccggccctacacgttccaggtgtcctccggagggaagcagattctctttcccaaagtcaacctgagccccgtgacgcccgcaaaggacacggggctcaccgctgctccccaggaaccaaaggcccccaaagccagcccagtccagcacgccctaccgtcgtccctgagcgttccccacaccgccattctggtcacgggcgcgcagctctgtggcccggcagtcaacctgagccagatcaaggacaccgcgtgcaagtccctcctgggcttggaggagaagaagcacgcggaagccccagctggggagaaccctccccgaggccccggcgacgcgagggcgggcagcgggaaggctaagcccccccaggagtctcccagcagcgcgtccgcactcgcagaatgggcttccattcggtccagaatcctgaagaacgcagagagtgacccgcgcagcagcgagagggaccagttgaggcccggtgatgagtccactcccaggggccggtgtgattcccgcgggaaccaacggaagactccgccagtcaatgcaaagttctctattatgcctgcctggcagaaattttccgatggtggcacggagacctccaaacagagcacggaagctgaaagcatacgaaaaagacccatgctgggacccagcgaagagacagccccccagcctcctcctgctggtgttcgcgagctcgggaagggtccggagaagtcggagatgcaccgggagcccgcagacaccaccgagggatgcaaatttgccaaagacctcccgtctttccttgtcccaagccttccttaccctccgcagaaagtggtggcccacacagagttcacgacctcgtcggacagcgagactgcaaacgggatagcaaagccagaccctgtgatgccaggtggagaggaaaaagcctcaccgtttggaataaaattgagaaggaccaactattccttgcgcttcaactgcgaccaacaggcagaacagaagaagaagaagaggcacagcagcaccggagacagcgcggatgcagggccgcctgcagcggggagcgctcgtggagagaaagagatggagggtgtggccctcaagcatggtccatccctcccccaagagcggaagcaagccccttccacccggagggactccgctgaaccttccagcagccgctctgttcctgtggcccaccctgggcctccaccggccagcagccagaccccggctccggagcacgacaaggcagcaaacaaaatgccactggcacaaaagccagcactggctcccaagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaatgtcagtgtcagcgtgcagcctggaagcagcagtgtcagcagagcaggttccctgcacaagtccactgctctgccagaagagaagagacccgagactgcagtgtccaggcttgagcgcagagaacagctgaaaaaggccaatactcttcctacgtctgtgacagtggagatctccgactcggctcccccagcgccgctggtaaaagaagtcaccaagaggttttccaccccggatgctgcccccgtgtcaacagaaccagcctggctggctttggccaaaaggaaagcaaaggcttggagcgactgtccacagattattaagtaaagagtgactctcacccatccctactgccagttattggctcctctcttgccctttttatttatttattttttatatggggtaaagaaatcaagctagggaaaagaagcatgttttataggctccaaaataatgtttagaaactgaactggtggtgttcattgtaaagagtggatttgcacaaccctaggtcctggtgcctcgagctcctcctagttctcaagagaaaattccgtccacaggaccacatgaagcaaaatctctaagctaagaactcgtgagagcctgccatgcccatttcatggccttgcacacacacccacccacacaccattcagaacatgtacttttgccaacctttggtaatggttttttgattctatgcactaattttctttgtccaaaacatttactctaccatatgtctgggaatgtttatcctttctacagtaatggtgaaaggatcatatctagctaaaagcaagaacacccattctcctgaatgcagtgagtaattgggaatcacaaggaacattctggcacccaactgtgcccatcttagttttcatgagttttccccactctgaagctgtaacccagaaggcacatccattcacatttttaccgcactgtggattcatagtgtggggccctgttattccaataccctccttaaggacatgtgaagcatttggcccagttggctcccagggaacattttaatttaatgtagtgaagaaagaccattctagatcagagctacaagttcactttctgtctctgagaatctccatctagggcagtagttcttatgatgtgtaggctccctcctagggcctactcaatcagagcctgtggggactgggccaggaatatgtattctggcaaaaactcttcaggtcagttctgatagatcccaaaggttaagaactgtgagaaacactgatcctaatgcaatctagtttttcagacttcgaaggggaggctcattcactcaaaaagcaacagtgagacaggaaaaataataaaacaaccccccaagccagccatttattacaagaagcaacaggttattgacattacatgtttgaaaattccctttggtctttagggaaaataaacaggaagccaagatttggagcctttgtaataaggacttcctgcagaaagtcttttctttactataattgagtaattcatatttagagtcacatgtccagtagcatttctaattttgagcattcaccttgctacctttaaaaaacatctgagttttaagtggcctttttatcatcatacacatgtgcatacaaagaagggacttggcagtttaaaagccacatatattcacttttattgccctaaatttacatgaaacagacatactggcaaactcacatattgctggtgctaaccttatatttcatagtgttggcatattccccttttcttagattcttactccgaaatataggtacacatcctttgctctgtgcagagggaattacatcctttttcctctcctacaaaaacatgctttattaagtatccatcattactttcctttatgctcgctcaatatgcaatgtgctgttattctaccatgtaccttaaataaaggatgatggcaaagtta

SEQ ID NO: 69156 - DNA, 4758 bp, Homo sapiens
acttaggctaggtacgaggctgggtgttcacaccgccattctggtcacgggcgcgcagctctgtggcccggcagtcaacctgagccagatcaaggacaccgcgtgcaagtccctcctgggcttggaggagaagaagcacgcggaagccccagctggggagaaccctccccgaggccccggcgacgcgagggcgggcagcgggaaggctaagcccccccaggagtctcccagcagcgcgtccgcactcgcagaatgggcttccattcggtccagaatcctgaagaacgcagagagtgacccgcgcagcagcgagagggaccagttgaggcccggtgatgagtccactcccaggggccggtgtgattcccgcgggaaccaacggaagactccgccagtcaatgcaaagttctctattatgcctgcctggcagaaattttccgatggtggcacggagacctccaaacagagcacggaagctgaaagcatacgaaaaagacccatgctgggacccagcgaagagacagccccccagcctcctcctgctggtgttcgcgagctcgggaagggtccggagaagtcggagatgcaccgggagcccgcagacaccaccgagggatgcaaatttgccaaagacctcccgtctttccttgtcccaagccttccttaccctccgcagaaagtggtggcccacacagagttcacgacctcgtcggacagcgagactgcaaacgggatagcaaagccagaccctgtgatgccaggtggagaggaaaaagcctcaccgtttggaataaaattgagaaggaccaactattccttgcgcttcaactgcgaccaacaggcagaacagaagaagaagaagaggcacagcagcaccggagacagcgcggatgcagggccgcctgcagcggggagcgctcgtggagagaaagagatggagggtgtggccctcaagcatggtccatccctcccccaagagcggaagcaagccccttccacccggagggactccgctgaaccttccagcagccgctctgttcctgtggcccaccctgggcctccaccggccagcagccagaccccggctccggagcacgacaaggcagcaaacaaaatgccactggcacaaaagccagcactggctcccaagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaatgtcagtgtcagcgtgcagcctggaagcagcagtgtcagcagagcaggttccctgcacaagtccactgctctgccagaagagaagagacccgagactgcagtgtccaggcttgagcgcagagaacagctgaaaaaggccaatactcttcctacgtctgtgacagtggagatctccgactcggctcccccagcgccgctggtaaaagaagtcaccaagaggttttccaccccggatgctgcccccgtgtcaacagaaccagcctggctggctttggccaaaaggaaagcaaaggcttggagcgactgtccacagattattaagtaaagagtgactctcacccatccctactgccagttattggctcctctcttgccctttttatttatttattttttatatggggtaaagaaatcaagctagggaaaagaagcatgttttataggctccaaaataatgtttagaaactgaactggtggtgttcattgtaaagagtggatttgcacaaccctaggtcctggtgcctcgagctcctcctagttctcaagagaaaattccgtccacaggaccacatgaagcaaaatctctaagctaagaactcgtgagagcctgccatgcccatttcatggccttgcacacacacccacccacacaccattcagaacatgtacttttgccaacctttggtaatggttttttgattctatgcactaattttctttgtccaaaacatttactctaccatatgtctgggaatgtttatcctttctacagtaatggtgaaaggatcatatctagctaaaagcaagaacacccattctcctgaatgcagtgagtaattgggaatcacaaggaacattctggcacccaactgtgcccatcttagttttcatgagttttccccactctgaagctgtaacccagaaggcacatccattcacatttttaccgcactgtggattcatagtgtggggccctgttattccaataccctccttaaggacatgtgaagcatttggcccagttggctcccagggaacattttaatttaatgtagtgaagaaagaccattctagatcagagctacaagttcactttctgtctctgagaatctccatctagggcagtagttcttatgatgtgtaggctccctcctagggcctactcaatcagagcctgtggggactgggccaggaatatgtattctggcaaaaactcttcaggtcagttctgatagatcccaaaggttaagaactgtgagaaacactgatcctaatgcaatctagtttttcagacttcgaaggggaggctcattcactcaaaaagcaacagtgagacaggaaaaataataaaacaaccccccaagccagccatttattacaagaagcaacaggttattgacattacatgtttgaaaattccctttggtctttagggaaaataaacaggaagccaagatttggagcctttgtaataaggacttcctgcagaaagtcttttctttactataattgagtaattcatatttagagtcacatgtccagtagcatttctaattttgagcattcaccttgctacctttaaaaaacatctgagttttaagtggcctttttatcatcatacacatgtgcatacaaagaagggacttggcagtttaaaagccacatatattcacttttattgccctaaatttacatgaaacagacatactggcaaactcacatattgctggtgctaaccttatatttcatagtgttggcatattccccttttcttagattcttactccgaaatataggtacacatcctttgctctgtgcagagggaattacatcctttttcctctcctacaaaaacatgctttattaagtatccatcattactttcctttatgctcgctcaatatgcaatgtgctgttattctaccatgtaccttaaataaaggatgatggcaaagttatttaccatgtagaaaccattttctttctagaaacaatagctcagcctcactgtagcagctggcatgtgtggtcaagtggatagttgtactcttgcaagttggatttaatatcatatatactggaccttcagactgttaaaaatcaatgtaacctttttttattgctatggcaagcaattagtatttcactgcacgtcttccatactaatgttcatttctaaatcttatatgtaggcatttgttagttccaatgatttcctcactaatataacactttttaatgggaatctttccacctacagccctggaatgataatgctacagtaattcttctgaattgactttttctttcatcctgtcagctttggacaatatcccaattatggcagggaacaggtggggaactaagatcagttacaaaaagttgtagatgtgtcaactttgtattggctgggatatcactgtgcccaaacaaaacaggcgaaatacctcagttaaaatttttccatcaaagtctttaaaagaagagtatactgaagaaagggcagtcacaatacttacttctaacagcttctaaagggtacatgtttaacatttcatttcaaaatcaccccaaatttgcactaaataccaatgaagtgttattttgctttagtagtcttctgagcaacaaactatggggaattctgtaaaaacatataaaaagttcaagactttttttttaaatgaatgattactatgttaaatgcaaactttttttttttttatttaaacaaacatacacttctcctggcaaggttatagatgattaacctctgttcatagacttatatataaaactagagggttttttgtttacttttttaatttttcaagtgcaattgtttcttacacagacattattactattaaattatcatttagccagttatctgcaaatatatagtatgtattgtctcttcttgtgacgtttagtttaattgcttattttaaagcagaaacattagttacaagtgtcttacaatatttttaccaacagtaaagtagagacttaatgaaaataccttagtgtgattttaatataatttgcatattttagttgtataaagttttaatgtaaaatgtccattattgaagggaaaagatctttcaataaaaaatacccacgaga

SEQ ID NO: 69157 - DNA, 4901 bp, Homo sapiens
acttaggctaggtacgaggctgggtgttcacaccgccattctggtcacgggcgcgcagctctgtggcccggcagtcaacctgagccagatcaaggacaccgcgtgcaagtccctcctgggcttggaggagaagaagcacgcggaagccccagctggggagaaccctccccgaggccccggcgacgcgagggcgggcagcgggaaggctaagcccccccaggagtctcccagcagcgcgtccgcactcgcagaatgggcttccattcggtccagaatcctgaagaacgcagagagtgacccgcgcagcagcgagagggaccagttgaggcccggtgatgagtccactcccaggggccggtgtgattcccgcgggaaccaacggaagactccgccagtcaatgcaaagttctctattatgcctgcctggcagaaattttccgatggtggcacggagacctccaaacagagcacggaagctgaaagcatacgaaaaagacccatgctgggacccagcgaagagacagccccccagcctcctcctgctggtgttcgcgagctcgggaagggtccggagaagtcggagatgcaccgggagcccgcagacaccaccgagggatgcaaatttgccaaagacctcccgtctttccttgtcccaagccttccttaccctccgcagaaagtggtggcccacacagagttcacgacctcgtcggacagcgagactgcaaacgggatagcaaagccagaccctgtgatgccaggtggagaggaaaaagcctcaccgtttggaataaaattgagaaggaccaactattccttgcgcttcaactgcgaccaacaggcagaacagaagaagaagaagaggcacagcagcaccggagacagcgcggatgcagggccgcctgcagcggggagcgctcgtggagagaaagagatggagggtgtggccctcaagcatggtccatccctcccccaagagcggaagcaagccccttccacccggagggactccgctgaaccttccagcagccgctctgttcctgtggcccaccctgggcctccaccggccagcagccagaccccggctccggagcacgacaaggcagcaaacaaaatgccactggcacaaaagccagcactggctcccaagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaatgtcagtgtcagcgtgcagcctggaagcagcagtgtcagcagagcaggttccctgcacaagtccactgctctgccagaagagaagagacccgagactgcagtgtccaggcttgagcgcagagaacagctgaaaaaggccaatactcttcctacgtctgtgacagtggagatctccgactcggctcccccagcgccgctggtaaaagaagtcaccaagaggttttccaccccggatgctgcccccgtgtcaacagaaccagcctggctggctttggccaaaaggaaagcaaaggcttggagcgactgtccacagattattaagtaaagagtgactctcacccatccctactgccagttattggctcctctcttgccctttttatttatttattttttatatggggtaaagaaatcaagctagggaaaagaagcatgttttataggctccaaaataatgtttagaaactgaactggtggtgttcattgtaaagagtggatttgcacaaccctaggtcctggtgcctcgagctcctcctagttctcaagagaaaattccgtccacaggaccacatgaagcaaaatctctaagctaagaactcgtgagagcctgccatgcccatttcatggccttgcacacacacccacccacacaccattcagaacatgtacttttgccaacctttggtaatggttttttgattctatgcactaattttctttgtccaaaacatttactctaccatatgtctgggaatgtttatcctttctacagtaatggtgaaaggatcatatctagctaaaagcaagaacacccattctcctgaatgcagtgagtaattgggaatcacaaggaacattctggcacccaactgtgcccatcttagttttcatgagttttccccactctgaagctgtaacccagaaggcacatccattcacatttttaccgcactgtggattcatagtgtggggccctgttattccaataccctccttaaggacatgtgaagcatttggcccagttggctcccagggaacattttaatttaatgtagtgaagaaagaccattctagatcagagctacaagttcactttctgtctctgagaatctccatctagggcagtagttcttatgatgtgtaggctccctcctagggcctactcaatcagagcctgtggggactgggccaggaatatgtattctggcaaaaactcttcaggtcagttctgatagatcccaaaggttaagaactgtgagaaacactgatcctaatgcaatctagtttttcagacttcgaaggggaggctcattcactcaaaaagcaacagtgagacaggaaaaataataaaacaaccccccaagccagccatttattacaagaagcaacaggttattgacattacatgtttgaaaattccctttggtctttagggaaaataaacaggaagccaagatttggagcctttgtaataaggacttcctgcagaaagtcttttctttactataattgagtaattcatatttagagtcacatgtccagtagcatttctaattttgagcattcaccttgctacctttaaaaaacatctgagttttaagtggcctttttatcatcatacacatgtgcatacaaagaagggacttggcagtttaaaagccacatatattcacttttattgccctaaatttacatgaaacagacatactggcaaactcacatattgctggtgctaaccttatatttcatagtgttggcatattccccttttcttagattcttactccgaaatataggtacacatcctttgctctgtgcagagggaattacatcctttttcctctcctacaaaaacatgctttattaagtatccatcattactttcctttatgctcgctcaatatgcaatgtgctgttattctaccatgtaccttaaataaaggatgatggcaaagttatttaccatgtagaaaccattttctttctagaaacaatagctcagcctcactgtagcagctggcatgtgtggtcaagtggatagttgtactcttgcaagttggatttaatatcatatatactggaccttcagactgttaaaaatcaatgtaacctttttttattgctatggcaagcaattagtatttcactgcacgtcttccatactaatgttcatttctaaatcttatatgtaggcatttgttagttccaatgatttcctcactaatataacactttttaatgggaatctttccacctacagccctggaatgataatgctacagtaattcttctgaattgactttttctttcatcctgtcagctttggacaatatcccaattatggcagggaacaggtggggaactaagatcagttacaaaaagttgtagatgtgtcaactttgtattggctgggatatcactgtgcccaaacaaaacaggcgaaatacctcagttaaaatttttccatcaaagtctttaaaagaagagtatactgaagaaagggcagtcacaatacttacttctaacagcttctaaagggtacatgtttaacatttcatttcaaaatcaccccaaatttgcactaaataccaatgaagtgttattttgctttagtagtcttctgagcaacaaactatggggaattctgtaaaaacatataaaaagttcaagactttttttttaaatgaatgattactatgttaaatgcaaactttttttttttttatttaaacaaacatacacttctcctggcaaggttatagatgattaacctctgttcatagacttatatataaaactagagggttttttgtttacttttttaatttttcaagtgcaattgtttcttacacagacattattactattaaattatcatttagccagttatctgcaaatatatagtatgtattgtctcttcttgtgacgtttagtttaattgcttattttaaagcagaaacattagttacaagtgtcttacaatatttttaccaacagtaaagtagagacttaatgaaaataccttagtgtgattttaatataatttgcatattttagttgtataaagttttaatgtaaaatgtccattattgaagggaaaagatctttcaataaaaaatacccacgagatcttcggcactgatggaatttgatttcgatgaccaactgcaaaacaatctcattatatttacataacttttgttgaacaagaacaactttaaactgttttattacatttttttcctaggtatttttagagaaaaataatgaac

SEQ ID NO: 69158 - DNA, 4595 bp, Homo sapiens
acttaggctaggtacgaggctgggtgttcacaccgccattctggtcacgggcgcgcagctctgtggcccggcagtcaacctgagccagatcaaggacaccgcgtgcaagtccctcctgggcttggaggagaagaagcacgcggaagccccagctggggagaaccctccccgaggccccggcgacgcgagggcgggcagcgggaaggctaagcccccccaggagtctcccagcagcgcgtccgcactcgcagaatgggcttccattcggtccagaatcctgaagaacgcagagagtgacccgcgcagcagcgagagggaccagttgaggcccggtgatgagtccactcccaggggccggtgtgattcccgcgggaaccaacggaagactccgccagtcaatgcaaagttctctattatgcctgcctggcagaaattttccgatggtggcacggagacctccaaacagagcacggaagctgaaagcatacgaaaaagacccatgctgggacccagcgaagagacagccccccagcctcctcctgctggtgttcgcgagctcgggaagggtccggagaagtcggagatgcaccgggagcccgcagacaccaccgagggatgcaaatttgccaaagacctcccgtctttccttgtcccaagccttccttaccctccgcagaaagtggtggcccacacagagttcacgacctcgtcggacagcgagactgcaaacgggatagcaaagccagaccctgtgatgccaggtggagaggaaaaagcctcaccgtttggaataaaattgagaaggaccaactattccttgcgcttcaactgcgaccaacaggcagaacagaagaagaagaagaggcacagcagcaccggagacagcgcggatgcagggccgcctgcagcggggagcgctcgtggagagaaagagatggagggtgtggccctcaagcatggtccatccctcccccaagagcggaagcaagccccttccacccggagggactccgctgaaccttccagcagccgctctgttcctgtggcccaccctgggcctccaccggccagcagccagaccccggctccggagcacgacaaggcagcaaacaaaatgccactggcacaaaagccagcactggctcccaagcccaccagtcagaccccaccagcatccccactttccaaactgagcaggccctacttggtagagctgctgtctcgccgagcggggaggccggacccagagccaagtgagccgtccaaggaggaccaggagagcagtgaccgccggccaccctcgcccccaggccccgaggaaaggaagggacagaagagggacgaggaggaagaggcgacagagaggaaacctgcttccccacctctgcctgccactcagcaagagaaaccttctcaaacacccgaggccgggaggaaagagaagccgatgcttcagagcagacactccttagatggctccaaacttacagagaaagtggaaactgctcagccgctgtggataacgttagcactgcaaaagcaaaaggggtttcgggagcagcaggcgacgcgggaggagagaaagcaagccagagaggccaaacaggcagaaaagctctccaaagaaaattggagatctccgactcggctcccccagcgccgctggtaaaagaagtcaccaagaggttttccaccccggatgctgcccccgtgtcaacagaaccagcctggctggctttggccaaaaggaaagcaaaggcttggagcgactgtccacagattattaagtaaagagtgactctcacccatccctactgccagttattggctcctctcttgccctttttatttatttattttttatatggggtaaagaaatcaagctagggaaaagaagcatgttttataggctccaaaataatgtttagaaactgaactggtggtgttcattgtaaagagtggatttgcacaaccctaggtcctggtgcctcgagctcctcctagttctcaagagaaaattccgtccacaggaccacatgaagcaaaatctctaagctaagaactcgtgagagcctgccatgcccatttcatggccttgcacacacacccacccacacaccattcagaacatgtacttttgccaacctttggtaatggttttttgattctatgcactaattttctttgtccaaaacatttactctaccatatgtctgggaatgtttatcctttctacagtaatggtgaaaggatcatatctagctaaaagcaagaacacccattctcctgaatgcagtgagtaattgggaatcacaaggaacattctggcacccaactgtgcccatcttagttttcatgagttttccccactctgaagctgtaacccagaaggcacatccattcacatttttaccgcactgtggattcatagtgtggggccctgttattccaataccctccttaaggacatgtgaagcatttggcccagttggctcccagggaacattttaatttaatgtagtgaagaaagaccattctagatcagagctacaagttcactttctgtctctgagaatctccatctagggcagtagttcttatgatgtgtaggctccctcctagggcctactcaatcagagcctgtggggactgggccaggaatatgtattctggcaaaaactcttcaggtcagttctgatagatcccaaaggttaagaactgtgagaaacactgatcctaatgcaatctagtttttcagacttcgaaggggaggctcattcactcaaaaagcaacagtgagacaggaaaaataataaaacaaccccccaagccagccatttattacaagaagcaacaggttattgacattacatgtttgaaaattccctttggtctttagggaaaataaacaggaagccaagatttggagcctttgtaataaggacttcctgcagaaagtcttttctttactataattgagtaattcatatttagagtcacatgtccagtagcatttctaattttgagcattcaccttgctacctttaaaaaacatctgagttttaagtggcctttttatcatcatacacatgtgcatacaaagaagggacttggcagtttaaaagccacatatattcacttttattgccctaaatttacatgaaacagacatactggcaaactcacatattgctggtgctaaccttatatttcatagtgttggcatattccccttttcttagattcttactccgaaatataggtacacatcctttgctctgtgcagagggaattacatcctttttcctctcctacaaaaacatgctttattaagtatccatcattactttcctttatgctcgctcaatatgcaatgtgctgttattctaccatgtaccttaaataaaggatgatggcaaagttatttaccatgtagaaaccattttctttctagaaacaatagctcagcctcactgtagcagctggcatgtgtggtcaagtggatagttgtactcttgcaagttggatttaatatcatatatactggaccttcagactgttaaaaatcaatgtaacctttttttattgctatggcaagcaattagtatttcactgcacgtcttccatactaatgttcatttctaaatcttatatgtaggcatttgttagttccaatgatttcctcactaatataacactttttaatgggaatctttccacctacagccctggaatgataatgctacagtaattcttctgaattgactttttctttcatcctgtcagctttggacaatatcccaattatggcagggaacaggtggggaactaagatcagttacaaaaagttgtagatgtgtcaactttgtattggctgggatatcactgtgcccaaacaaaacaggcgaaatacctcagttaaaatttttccatcaaagtctttaaaagaagagtatactgaagaaagggcagtcacaatacttacttctaacagcttctaaagggtacatgtttaacatttcatttcaaaatcaccccaaatttgcactaaataccaatgaagtgttattttgctttagtagtcttctgagcaacaaactatggggaattctgtaaaaacatataaaaagttcaagactttttttttaaatgaatgattactatgttaaatgcaaactttttttttttttatttaaacaaacatacacttctcctggcaaggttatagatgattaacctctgttcatagacttatatataaaactagagggttttttgtttacttttttaatttttcaagtgcaattgtttcttacacagacattattactattaaattatcatttagccagttatctgcaaatatatagtatgtattgtctcttcttgtgacgtttagtttaattgcttattttaaagcagaaacattagttacaagtgtcttacaatatttttaccaacagtaaagtagagacttaatgaaaataccttagtgtgattttaatataatttgcatattttagttgtataaagttttaatgtaaaatgtccattattgaagggaaaagatctttcaataaaaaatacccacgaga

SEQ ID NO: 69159 - DNA, 2975 bp, Homo sapiens
acatccggggtggaaaacctcttggtgacttcttttaccagcggcgctgggggagccgagtcggagttttccaccccggatgctgcccccgtgtcaacagaaccagcctggctggctttggccaaaaggaaagcaaaggcttggagcgactgtccacagattattaagtaaagagtgactctcacccatccctactgccagttattggctcctctcttgccctttttatttatttattttttatatggggtaaagaaatcaagctagggaaaagaagcatgttttataggctccaaaataatgtttagaaactgaactggtggtgttcattgtaaagagtggatttgcacaaccctaggtcctggtgcctcgagctcctcctagttctcaagagaaaattccgtccacaggaccacatgaagcaaaatctctaagctaagaactcgtgagagcctgccatgcccatttcatggccttgcacacacacccacccacacaccattcagaacatgtacttttgccaacctttggtaatggttttttgattctatgcactaattttctttgtccaaaacatttactctaccatatgtctgggaatgtttatcctttctacagtaatggtgaaaggatcatatctagctaaaagcaagaacacccattctcctgaatgcagtgagtaattgggaatcacaaggaacattctggcacccaactgtgcccatcttagttttcatgagttttccccactctgaagctgtaacccagaaggcacatccattcacatttttaccgcactgtggattcatagtgtggggccctgttattccaataccctccttaaggacatgtgaagcatttggcccagttggctcccagggaacattttaatttaatgtagtgaagaaagaccattctagatcagagctacaagttcactttctgtctctgagaatctccatctagggcagtagttcttatgatgtgtaggctccctcctagggcctactcaatcagagcctgtggggactgggccaggaatatgtattctggcaaaaactcttcaggtcagttctgatagatcccaaaggttaagaactgtgagaaacactgatcctaatgcaatctagtttttcagacttcgaaggggaggctcattcactcaaaaagcaacagtgagacaggaaaaataataaaacaaccccccaagccagccatttattacaagaagcaacaggttattgacattacatgtttgaaaattccctttggtctttagggaaaataaacaggaagccaagatttggagcctttgtaataaggacttcctgcagaaagtcttttctttactataattgagtaattcatatttagagtcacatgtccagtagcatttctaattttgagcattcaccttgctacctttaaaaaacatctgagttttaagtggcctttttatcatcatacacatgtgcatacaaagaagggacttggcagtttaaaagccacatatattcacttttattgccctaaatttacatgaaacagacatactggcaaactcacatattgctggtgctaaccttatatttcatagtgttggcatattccccttttcttagattcttactccgaaatataggtacacatcctttgctctgtgcagagggaattacatcctttttcctctcctacaaaaacatgctttattaagtatccatcattactttcctttatgctcgctcaatatgcaatgtgctgttattctaccatgtaccttaaataaaggatgatggcaaagttatttaccatgtagaaaccattttctttctagaaacaatagctcagcctcactgtagcagctggcatgtgtggtcaagtggatagttgtactcttgcaagttggatttaatatcatatatactggaccttcagactgttaaaaatcaatgtaacctttttttattgctatggcaagcaattagtatttcactgcacgtcttccatactaatgttcatttctaaatcttatatgtaggcatttgttagttccaatgatttcctcactaatataacactttttaatgggaatctttccacctacagccctggaatgataatgctacagtaattcttctgaattgactttttctttcatcctgtcagctttggacaatatcccaattatggcagggaacaggtggggaactaagatcagttacaaaaagttgtagatgtgtcaactttgtattggctgggatatcactgtgcccaaacaaaacaggcgaaatacctcagttaaaatttttccatcaaagtctttaaaagaagagtatactgaagaaagggcagtcacaatacttacttctaacagcttctaaagggtacatgtttaacatttcatttcaaaatcaccccaaatttgcactaaataccaatgaagtgttattttgctttagtagtcttctgagcaacaaactatggggaattctgtaaaaacatataaaaagttcaagactttttttttaaatgaatgattactatgttaaatgcaaactttttttttttttatttaaacaaacatacacttctcctggcaaggttatagatgattaacctctgttcatagacttatatataaaactagagggttttttgtttacttttttaatttttcaagtgcaattgtttcttacacagacattattactattaaattatcatttagccagttatctgcaaatatatagtatgtattgtctcttcttgtgacgtttagtttaattgcttattttaaagcagaaacattagttacaagtgtcttacaatatttttaccaacagtaaagtagagacttaatgaaaataccttagtgtgattttaatataatttgcatattttagttgtataaagttttaatgtaaaatgtccattattgaagggaaaagatctttcaataaaaaatacccacgaga

SEQ ID NO: 69160 - DNA, 2926 bp, Homo sapiens
ggtgacaacgtttggaagggccagggcgaccggcagtgtgcacagggactgtgtcgggcttggacctcacctgatcctctctcttagcgcgacccttcctctgctccctgtctcctctttctgccacttgtgcgctgcttccgcgcactcccggctccctagcggcaggaggaggaaggcgcacagcgggtggagagggtgcgccaaggagaggtaaccccttcgggagcccggggaatcccggccgccaccaggggccgtgccaccgccctcgcgggaccaaagcttccggcgtgtccccaactttgtggcgccctcaggccgcggcgactgggttagagatgccttccagcggcagagcgctgctggactcgccgctggacagcggctccctgacctccctggactctagtgtcttctgcagcgagggtgaaggggagcccttggcgctcggggactgcttcacggtcaacgtgggcggcagccgcttcgtgctctcgcagcaggcgctgtcctgcttcccgcacacgcgccttggcaagctggccgtggtggtggcttcctaccgccgccccggggccctggccgccgtgcccagccctctggagctttgcgacgatgccaaccccgtggacaacgagtacttcttcgaccgcagctcgcaggcgttccgatatgtcctgcactactaccgcaccggccgcctgcatgtcatggagcagctgtgcgcgctctccttcctgcaggagatccagtactggggcatcgatgagctcagcatcgattcctgctgcagggacagatacttcagaaggaaagagctgagtgaaactttagacttcaagaaggacacagaagaccaggaaagtcaacatgagagtgaacaggacttctcccaaggaccttgtcccactgttcgccagaagctctggaatatcctggagaaacctggatcttccacagctgcccgtatctttggcgtcatctccattatcttcgtggtggtgtccatcattaacatggccctgatgtcagctgagttaagctggctggacctgcagctgctggaaatcctggagtatgtgtgcattagctggttcaccggggagtttgtcctccgcttcctgtgtgtgcgggacaggtgtcgcttcctaagaaaggtgccaaacatcatagacctccttgccatcttgcccttctacatcactcttctggtagagagcctaagtgggagccagaccacgcaggagctggagaacgtggggcgcattgtccaggtgttgaggctgctcagggctctgcgcatgctaaagctgggcagacattccacaggattacgctcccttgggatgacaatcacccagtgttacgaagaagtcggcctactgctcctatttctatccgtgggaatctctatattttcaactgtagaatactttgctgagcaaagcattcctgacacaaccttcacaagtgtcccttgtgcatggtggtgggccaccacctctatgactactgtgggatatggggacattagaccagacaccaccacaggcaaaatcgtggccttcatgtgtatattatcgggaattcttgtcttggccttgcctattgctattattaacgatcgcttctctgcttgctacttcaccttgaaactcaaggaagcagctgttagacagcgtgaagccctaaagaagcttaccaagaatatagccactgactcatatatcagtgttaacttgagagatgtctatgcccggagtatcatggagatgctgcgactgaaaggcagagaaagagcaagtactaggagcagcgggggagatgatttctggttttgaattaattttcaatttatttacaaaagctatgtacaattaactaaaatgataaagcagtgatgtggatttctgtattctgatgatgagtctcttcagagtactgctcatcttaattaatttttgctgatatattgcttcatctactagaatatttcacatcacctataacaactgcacagtgttctgacacatttgagtgtccaaaatagccaattaacacaaccaaatacaactgggccaatataaacatgtttgaattgtcaaatataaaataatgttattgcaatacatacaaaaaagttaaagattttatgtatcactaacattagaagttttttgcaccactaattttttaaaaatggaaggtaaactgcatagcccagagaaagataagtaaatatttaagaacatattgaacaactttgctatttaaagatattatccaagtacataaattactccgttctctatcagttaaagctattgaatataatacttagctttacaagagaaaacccatatttgatgggcagagattatatccctatcttctttttcatgtaaaccactggtcacaaatgaactgatctctgtatcccattattactataagaggtgggaatcccaaaactgcttagattgcagtacatgagtctacacaaagacttcaacaattgcacatcttcattctcccaactgagtgtagtatgtggagcataaaacagcatatttcttagtatttcatgaatatcagatggtctttaaatgtctctttatggatgtattgttcacattatggctttaaaataatgaatatgtaaaagtgaggtagtgaacatcctaaatttctacactggaattactaaataatcttatttcataaaatgggaaatatatgttaaatgacatcactggatgaacttgaagatcttttacttgttaacaaaaaaatactatggacagctttctgattgttggggtaaatagcaaatgttcaaactttgcaggcattttgacattcatcataacaacacaattcctagacattgtattatataattaaagccaaaacctctaaagct

SEQ ID NO: 69161 - DNA, 3202 bp, Homo sapiens
ggtgacaacgtttggaagggccagggcgaccggcagtgtgcacagggactgtgtcgggcttggacctcacctgatcctctctcttagcgcgacccttcctctgctccctgtctcctctttctgccacttgtgcgctgcttccgcgcactcccggctccctagcggcaggaggaggaaggcgcacagcgggtggagagggtgcgccaaggagaggtaaccccttcgggagcccggggaatcccggccgccaccaggggccgtgccaccgccctcgcgggaccaaagcttccggcgtgtccccaactttgtggcgccctcaggccgcggcgactgggttagagatgccttccagcggcagagcgctgctggactcgccgctggacagcggctccctgacctccctggactctagtgtcttctgcagcgagggtgaaggggagcccttggcgctcggggactgcttcacggtcaacgtgggcggcagccgcttcgtgctctcgcagcaggcgctgtcctgcttcccgcacacgcgccttggcaagctggccgtggtggtggcttcctaccgccgccccggggccctggccgccgtgcccagccctctggagctttgcgacgatgccaaccccgtggacaacgagtacttcttcgaccgcagctcgcaggcgttccgatatgtcctgcactactaccgcaccggccgcctgcatgtcatggagcagctgtgcgcgctctccttcctgcaggagatccagtactggggcatcgatgagctcagcatcgattcctgctgcagggacagatacttcagaaggaaagagctgagtgaaactttagacttcaagaaggacacagaagaccaggaaagtcaacatgagagtgaacaggacttctcccaaggaccttgtcccactgttcgccagaagctctggaatatcctggagaaacctggatcttccacagctgcccgtatctttggcgtcatctccattatcttcgtggtggtgtccatcattaacatggccctgatgtcagctgagttaagctggctggacctgcagctgctggaaatcctggagtatgtgtgcattagctggttcaccggggagtttgtcctccgcttcctgtgtgtgcgggacaggtgtcgcttcctaagaaaggtgccaaacatcatagacctccttgccatcttgcccttctacatcactcttctggtagagagcctaagtgggagccagaccacgcaggagctggagaacgtggggcgcattgtccaggtgttgaggctgctcagggctctgcgcatgctaaagctgggcagacattccacaggattacgctcccttgggatgacaatcacccagtgttacgaagaagtcggcctactgctcctatttctatccgtgggaatctctatattttcaactgtagaatactttgctgagcaaagcattcctgacacaaccttcacaagtgtcccttgtgcatggtggtgggccaccacctctatgactactgtgggatatggggacattagaccagacaccaccacaggcaaaatcgtggccttcatgtgtatattatcgggaattcttgtcttggccttgcctattgctattattaacgatcgcttctctgcttgctacttcaccttgaaactcaaggaagcagctgttagacagcgtgaagccctaaagaagcttaccaagaatatagccactgactcatatatcagtgttaacttgagagatgtctatgcccggagtatcatggagatgctgcgactgaaaggcagagaaagagcaagtactaggagcagcgggggagatgatttctggttttgaattaattttcaatttatttacaaaagctatgtacaattaactaaaatgataaagcagtgatgtggatttctgtattctgatgatgagtctcttcagagtactgctcatcttaattaatttttgctgatatattgcttcatctactagaatatttcacatcacctataacaactgcacagtgttctgacacatttgagtgtccaaaatagccaattaacacaaccaaatacaactgggccaatataaacatgtttgaattgtcaaatataaaataatgttattgcaatacatacaaaaaagttaaagattttatgtatcactaacattagaagttttttgcaccactaattttttaaaaatggaaggtaaactgcatagcccagagaaagataagtaaatatttaagaacatattgaacaactttgctatttaaagatattatccaagtacataaattactccgttctctatcagttaaagctattgaatataatacttagctttacaagagaaaacccatatttgatgggcagagattatatccctatcttctttttcatgtaaaccactggtcacaaatgaactgatctctgtatcccattattactataagaggtgggaatcccaaaactgcttagattgcagtacatgagtctacacaaagacttcaacaattgcacatcttcattctcccaactgagtgtagtatgtggagcataaaacagcatatttcttagtatttcatgaatatcagatggtctttaaatgtctctttatggatgtattgttcacattatggctttaaaataatgaatatgtaaaagtgaggtagtgaacatcctaaatttctacactggaattactaaataatcttatttcataaaatgggaaatatatgttaaatgacatcactggatgaacttgaagatcttttacttgttaacaaaaaaatactatggacagctttctgattgttggggtaaatagcaaatgttcaaactttgcaggcattttgacattcatcataacaacacaattcctagacattgtattatataattaaagccaaaacctctaaagctaagaactagctcatgattcccattattttagtaaatgagattctacaacctaagaataacaaggaatgcatcactttaatacctacatttccaatataatagagcccccaaggggaagaaaattggttcttgaggaaaaaaaaatcttatcacttcatttacaaaacacagataagcatattgagtatatctgtggtattaacatttcatgggggtgagatgttagggaaaaaagcctagaaggctctttgccaggggtgaatggtgataagaaat

SEQ ID NO: 69162 - DNA, 2754 bp, Homo sapiens
ggtgacaacgtttggaagggccagggcgaccggcagtgtgcacagggactgtgtcgggcttggacctcacctgatcctctctcttagcgcgacccttcctctgctccctgtctcctctttctgccacttgtgcgctgcttccgcgcactcccggctccctagcggcaggaggaggaaggcgcacagcgggtggagagggtgcgccaaggagaggtaaccccttcgggagcccggggaatcccggccgccaccaggggccgtgccaccgccctcgcgggaccaaagcttccggcgtgtccccaactttgtggcgccctcaggccgcggcgactgggttagagatgccttccagcggcagagcgctgctggactcgccgctggacagcggctccctgacctccctggactctagtgtcttctgcagcgagggtgaaggggagcccttggcgctcggggactgcttcacggtcaacgtgggcggcagccgcttcgtgctctcgcagcaggcgctgtcctgcttcccgcacacgcgccttggcaagctggccgtggtggtggcttcctaccgccgccccggggccctggccgccgtgcccagccctctggagctttgcgacgatgccaaccccgtggacaacgagtacttcttcgaccgcagctcgcaggcgttccgatatgtcctgcactactaccgcaccggccgcctgcatgtcatggagcagctgtgcgcgctctccttcctgcaggagatccagtactggggcatcgatgagctcagcatcgattcctgctgcagggacagatacttcagaaggaaagagctgagtgaaactttagacttcaagaaggacacagaagaccaggaaagtcaacatgagagtgaacaggacttctcccaaggaccttgtcccactgttcgccagaagctctggaatatcctggagaaacctggatcttccacagctgcccgtatctttggcgtcatctccattatcttcgtggtggtgtccatcattaacatggccctgatgtcagctgagttaagctggctggacctgcagctgctggaaatcctggagtatgtgtgcattagctggttcaccggggagtttgtcctccgcttcctgtgtgtgcgggacaggtgtcgcttcctaagaaaggattacgctcccttgggatgacaatcacccagtgttacgaagaagtcggcctactgctcctatttctatccgtgggaatctctatattttcaactgtagaatactttgctgagcaaagcattcctgacacaaccttcacaagtgtcccttgtgcatggtggtgggccaccacctctatgactactgtgggatatggggacattagaccagacaccaccacaggcaaaatcgtggccttcatgtgtatattatcgggaattcttgtcttggccttgcctattgctattattaacgatcgcttctctgcttgctacttcaccttgaaactcaaggaagcagctgttagacagcgtgaagccctaaagaagcttaccaagaatatagccactgactcatatatcagtgttaacttgagagatgtctatgcccggagtatcatggagatgctgcgactgaaaggcagagaaagagcaagtactaggagcagcgggggagatgatttctggttttgaattaattttcaatttatttacaaaagctatgtacaattaactaaaatgataaagcagtgatgtggatttctgtattctgatgatgagtctcttcagagtactgctcatcttaattaatttttgctgatatattgcttcatctactagaatatttcacatcacctataacaactgcacagtgttctgacacatttgagtgtccaaaatagccaattaacacaaccaaatacaactgggccaatataaacatgtttgaattgtcaaatataaaataatgttattgcaatacatacaaaaaagttaaagattttatgtatcactaacattagaagttttttgcaccactaattttttaaaaatggaaggtaaactgcatagcccagagaaagataagtaaatatttaagaacatattgaacaactttgctatttaaagatattatccaagtacataaattactccgttctctatcagttaaagctattgaatataatacttagctttacaagagaaaacccatatttgatgggcagagattatatccctatcttctttttcatgtaaaccactggtcacaaatgaactgatctctgtatcccattattactataagaggtgggaatcccaaaactgcttagattgcagtacatgagtctacacaaagacttcaacaattgcacatcttcattctcccaactgagtgtagtatgtggagcataaaacagcatatttcttagtatttcatgaatatcagatggtctttaaatgtctctttatggatgtattgttcacattatggctttaaaataatgaatatgtaaaagtgaggtagtgaacatcctaaatttctacactggaattactaaataatcttatttcataaaatgggaaatatatgttaaatgacatcactggatgaacttgaagatcttttacttgttaacaaaaaaatactatggacagctttctgattgttggggtaaatagcaaatgttcaaactttgcaggcattttgacattcatcataacaacacaattcctagacattgtattatataattaaagccaaaacctctaaagct

SEQ ID NO: 69163 - DNA, 1478 bp, Homo sapiens
  misc_feature (1053)..(1053): n is a, c, g, or t
ggaaggcttcaacatacagattttcagaggggggacacaattcagtccttagcacaactactggatatttaattatttattttaaaatcaagggaaagactgccaggagaggtggccaccagtcaaggctctgtgacataaaaagtggattattttctaactcgaaaatgaagaagatactgtccactgtcaccatggagatgatctatgcattagtcccttcccccacaaaaagcgctatttctgaattggggaatggagaggtatggaatgaacagaaggctgagacctgcctactggagccacaccatgaccatccagtgtctgggaagccctgggtggagctggaagctgctgatgaattggcagcactgataaaccaagacgaagagaaaacatccccagcagtgaggggtggagcatatggtggataaggagtctgtggagccaggcatctgtcagaaatgagaagtcaaagccagcagacaaagtcaagagagcagaggaagtattattataccagtggcattagagcaggagacagacaagtaaaaaggaatgatgagtgctggcagaaacaacagagtgctggactgccctaggcaggcaaggatagcaagggaggtgacagaagaatggagcctccacatatggaggagtctgcatggggaactgtagggtgaggaggattcccaattcaggtcttggaaacacacagatgtatgtgtagaaaacacggagagggtcaagagcaagatagaagcagccatgtgctttatgacccagtcatagaaatcacctatcagtcctttcgacatatttgttagaagcatgtccctaaatccagcccacatttaagggaaggaaaatcagcctccttcttttgaaagaaggagtgtcaaagaatgtatggacatttttactaccacattaatttttctttaaaactcctctttatctcacttttctactcagaaatctattatattacattacataaaatccacactctcttatttattccgggctctaaggatctatgcaattgggctncttccggttgtattttccagtgttttccagtgtgctccactttggttgactccttactggcctctgaatgcctcgtgaccatctcagcatttctgggctttggttcccactttaagagagttctctgattgtgtctttattaagcttgtgattgaaacacaattgagctgttgcagttaagaccatgggcgttggcttagacaagagtgggtaccagtctctacctatcttactcccttgggcaagttctccgacctacctaaactttagtttccttatttgtaaaacagggacaataatagattgcgtgaacactgccacagagtttatactccagttgtgggagggatgagaggaaaaaagagaaaaacaaatgaagtaaactagataaacatagagtacagcaggtgtgagaagtcctgaag

SEQ ID NO: 69164 - DNA, 404 bp, Homo sapiens
gtgcattgtctcccaggtatctctgagtaagtgaaaaagtaaaatttcctcctctcagtactcttatctgatactttcaagcagcccaacacccagtaaaagtgacatgtctaatccagaagtactggttttggagtaggcaacatatacaaagaggcaaatatccatgtgaggtgccatcccaggctatcacaatctttggatttaccctatctttaatagtgcctgaaggggttcttttaacttcaacctttgtaataaaatacaatgatgtaattgggaatgagtgaactccatagtaaactctatgattaaaaaaatagttaatatgtgtatatataaatatgcaaagtacaaataatacagagtgtggttttcatgttaatctcaattacttctcactg

SEQ ID NO: 69165 - DNA, 285 bp, Homo sapiens
gtactatgagaaactgctttacaaatgattttctgtggaaccctgtcaccagcatttagtgaaacatgctttccatttgaatatgcatttagatgaggccaactggctgctagatcatcgtctaatgggcctgtgatcccacatgaagattattttccctttggtcctagaaccactctccatcctgctcacccttatagactatatgagagggtccctaggtctcactttcaggtgggctcagccagtggaaatcagagaggtgtgagttcgtggtatgtattt

SEQ ID NO: 69166 - DNA, 5008 bp, Homo sapiens
  misc_feature (674)..(674): n is a, c, g, or t
  misc_feature (743)..(743): n is a, c, g, or t
  misc_feature (1105)..(1105): n is a, c, g, or t
  misc_feature (1507)..(1507): n is a, c, g, or t
  misc_feature (2814)..(2814): n is a, c, g, or t
  misc_feature (3699)..(3699): n is a, c, g, or t
aaaagagaaaactaatttgtggtattagaagcctggatagtggttatttttgagaagttagacatgctgatcaggtgaggcttcaagaggcacttaggaagtgctcataatgttctatttcttgattatgagtgctggttacgtgagttgatggactttgtggaaatttaatgagctatgattatgatttatttacttttctctatgactgttacactctagtaaaaagtttgcctaaaataagaaagtagcaaagaaagaaataatgagaagggttagacgaaataaaatttgctgattattggtaattattgaagctgggtgataagcgagggatctttatgtgttctctacttttgtgtatgtttgaaaagatccataatgataattaagataaactataggaatagaaagcagacaatttgttcctggatggggatgacagagaggagcaggagaaaggaaatatagagaataaaaggaaattttgtggtttaagataaatatattgtcttgattgtgatgatgctttcagaactaaccaaatagtcaaataatgcaaaaaacaaaaacaaacaaaaaaccccagaaaacttaggttcaacttattccaactgctgtcatctacctggaagaagaccagacactagtaacaacttaatacttgctaaatnaattaatgactggggtgccatttggcatattattggtctacattttttttaactatagaaaatattgancatgagtttcttacaggtaagttacagattatttgaaagaagtatgtacatgtaatcagaggtccacactcagggatgctctgagataagctatgtcagatgaataaggcactgaagcagcttttctggagatgaaaggcagccagccagcgttgattcccaggcttggtttattagcatcatgacctgggcaaaactttcatcacctggtgaggataatttattcctctccctagcctcatcaaggtataattgacaaatggaaattgtatatatttaaggtatacaacatgatatatgtatacattgtgaagtgattgccacagtcaaactaatgaacataaccatcacttcacataacnatcttttgtgtgtgtggtgagaacgcttaagatttactctcaacaattccatgtttacaaattattaactataggtcccatgctatatatctccagaactaactcatcttacaactgaaagtttgtaacctttgaccaaaatcctcccattcccccttaccatagctcctggtgactattattctactctgtttttttaattctgcctctttagattccacctataaatgagatcatgcatgtttgtctctctgtgtctggcttatttcaactaatataatgtcctccagattcatccacattgtcacaaatgacaggctttccttttttaagctgaataatatttcattatgtacacacacaccccccacattttctttatccattcatccattgacagangcttgggttgtttctatatcttggctattgtgaataatgctacagtgaatgttcagatatctctttaagataatgatttcagttcctttggatatatagccagaaatgaaattactggatcatatggtagttctatttttagtttttttttgtttttttaggaacctccatactgttttccataatggctctgtcagtttacaatctcggcagcagtgtgcagtggtttcttttcttcacagcttcaccaacacttgttatcatttgactttttgataatagccatcctaacaggtttgagatgacatctcatgcttttgacttgcatttccctgatgatttgtgatgttgagtacatttttatatgcctgttggaaaaatgtgtggtcttctttggaaaaatgtatattcaggtcctttgcccattttaaaagtaggctatttgtaggtttttgctattgagttgtatgagttccttttgcattttggatattagcttttcttgatgaatatatggcttgcaaatgttttttcccattccataggttatcttttcattttgttgagcatgttgaaacttttcagtttgacgtcctactcatttatttttgctttatttgcttatggttttgttgtcatatctacaaaatcattaccaagacccatgtcaaggagctttctcccatgctttcttcaaggatttttatggtttcaggtcttatgtttaagtctttaatcctttttgagttgttttttcgtgtatggtgtacaagaatagagatttaagctttaaagagagaaataagacaggtattctagattgaaatgcaaattacacctgcatttttaagatgacactttaagaaatagacctcttgcagcagaacacttcgtgttcctggaacctgtagtgcttgtttattctttttagatatttaattgacagccaaatccagaagagatagctgctgaatttgtcactaattctgagtctgattctctcgtttctttgcataaaagtagtgttaatgctctgtgctcaaattagagcacctaaaccatgtttctgaaatacagtgtatatgaaattaaagtgtaagttgcagctagtataaaaaaagcaaatcattttattgtggcagaataatagtgacatcgtatgggtgggcaaaaagccacaggaccctgattaggaaaatgattttagtcatgaaaaaagtatgctttctgagagaatggtccttcatcttttataccctagttaatttttttaaagggaagaaagccgatgtgcatttttacagttntatatgaagagtaagctgatgatgggtttcttttaaggggactcaacatagagttatcagatttggtaagtccattatgggcttaatgtagccttcactgctgagctcttattatagggcacttgttttcaggaggtagctggaaattggggggcttatatcaagttcagaaatagacatgactaatttaaaatgttagaagtcaggatactttttagtaaacattgtttttaaaaatctgttgtacgttttgggattctaactcatttgtgtttggtaagaattcactggtgcctacatatccagccattttactaattttacatacgtcatatttagatggtgtttacagtaactgctgttgctttaatttaggtcttgtactgcataggtgccatcattggaacatcaattatttagtgttaatatgcttagatgctagtaccagttgtgtaccgagtgtataactggctgatagaaaagtgagatgtggaagtgtcataaatatatggtgttcagcttattttggaattaggacaatggtttttttgttttgttttgtatttttcatgtatacttcctagatcaactctcagatctttaatttgtgcatagggcttcctgaggatgttgctcttactagaggtaattgatcagttttcattgatggctccctcataaagtggaagtttaaaacctaatctgtggaagccacgaaacagtttccctcagccagtcatggtggctcacacatgtaatcccagcactttgggagggcgagacaggcagatcacctgaggtcaggagtttgagaccagctgggcaacatggtgaaaccctgtctctactaaaaatacaaaaattagcctggcctggtggtacgtncctgtaatcccagctactcaggaggctgaggcatgagaatcgcttgaacctcaggaggcagaggttgtggtgagctgaggttgcgccactgcactctagcctggttgacagagtgagactctgtctcaaaaaaaaaagttttcctgctctcatttgctgtttcatcctaagaaacttgagaaatagactactttaaatattacagtgtatataaatgtgtaatttcataactctgcaaaagaaaacccagaaaaaataattttttaaactttctttttggggagggaggagttagtgaccccaatctgttattttacaaaatgggcaaacattgccaatctttctgaagtttgaaatgcagaatttgaagtttctcactgccctgcgttctagggaaagaaaaccattctatactagaaaggtgttatttaaaaagtttgatacccagaaaaattaattatttcattagttaccataatgcctgtgagttttttgccactttgatttaactgacattgacatgtctttgtgttagtgttgcagcttctcagtttttatattctacttcattggttgtaatttagtctcagatgatttcctataggatgtaatttcctgcatagtatatgggttctacttagcctgataaatgatctttccaacctcctggaagcactatatgccaaagatattctgatattttctaaagttttaaggaaaattattgggtatgtagttattagtccatggatttattttagtaattgtcattgtttcaccttttctcaagtttattgttcagcttaaggatattttcatttaggatatatagcccagacactgggttataattataatcaatatgtaagtatggttataattataatcagtatgtacgtataatcaatatgtaagtaatcatttgttatcaacctcctcattcctgttcttaatagctaacattttttgagctgttatactactgtgctaggcttctttcttaaattcctacttcacattaattatctcatttaacatttggctctgaggtatattctattaatatttccattttgcagatgagaatataaagtcgtagaagtttaaatacatgcttatttctcacagtaagaaatgctgagaccagcattaaaactcagctcatctggctgtagaacctgtactcttaagtactattttatgttgcatcacataatggtacatgatctttttttggttagtgtaatagttatgatgcttgaaaattttattgtctaccctttgtaatttattaaatatggatgtttcc

SEQ ID NO: 69167 - DNA, 689 bp, Homo sapiens
aaaagagaaaactaatttgtggtattagaagcctggatagtggttatttttgagaagttagacatgctgatcaggtgaggcttcaagaggcacttaggaagtgctcataatgttctatttcttgattatgagtgctggttacgtgagttgatggactttgtggaaatttaatgagctatgattatgatttatttacttttctctatgactgttacactctagtaaaaagtttgcctaaaataagaaagtagcaaagaaagaaataatgagaagggttagacgaaataaaatttgctgattattggtaattattgaagctgggtgataagcgagggatctttatgtgttctctacttttgtgtatgtttgaaaagatccataatgataattaagataaactataggaatagaaagcagacaatttgttcctggatggggatgacagagaggagcaggagaaaggaaatatagagaataaaaggaaattttgtggtttaagataaatatattgtcttgattgtgatgatgctttcagaactaaccaaatagtcaaataatgcaaaaaacaaaaacaaacaaaaaaccaggcccttaaacttcagctagacaaccatatgctgtgcttgaaaatcagaaaagcagccactcacatacattaagatgggctttgctacccttctgagttccgc

SEQ ID NO: 69168 - DNA, 5160 bp, Homo sapiens
  misc_feature (674)..(674): n is a, c, g, or t
  misc_feature (743)..(743): n is a, c, g, or t
  misc_feature (1105)..(1105): n is a, c, g, or t
  misc_feature (1507)..(1507): n is a, c, g, or t
  misc_feature (2814)..(2814): n is a, c, g, or t
  misc_feature (3699)..(3699): n is a, c, g, or t
aaaagagaaaactaatttgtggtattagaagcctggatagtggttatttttgagaagttagacatgctgatcaggtgaggcttcaagaggcacttaggaagtgctcataatgttctatttcttgattatgagtgctggttacgtgagttgatggactttgtggaaatttaatgagctatgattatgatttatttacttttctctatgactgttacactctagtaaaaagtttgcctaaaataagaaagtagcaaagaaagaaataatgagaagggttagacgaaataaaatttgctgattattggtaattattgaagctgggtgataagcgagggatctttatgtgttctctacttttgtgtatgtttgaaaagatccataatgataattaagataaactataggaatagaaagcagacaatttgttcctggatggggatgacagagaggagcaggagaaaggaaatatagagaataaaaggaaattttgtggtttaagataaatatattgtcttgattgtgatgatgctttcagaactaaccaaatagtcaaataatgcaaaaaacaaaaacaaacaaaaaaccccagaaaacttaggttcaacttattccaactgctgtcatctacctggaagaagaccagacactagtaacaacttaatacttgctaaatnaattaatgactggggtgccatttggcatattattggtctacattttttttaactatagaaaatattgancatgagtttcttacaggtaagttacagattatttgaaagaagtatgtacatgtaatcagaggtccacactcagggatgctctgagataagctatgtcagatgaataaggcactgaagcagcttttctggagatgaaaggcagccagccagcgttgattcccaggcttggtttattagcatcatgacctgggcaaaactttcatcacctggtgaggataatttattcctctccctagcctcatcaaggtataattgacaaatggaaattgtatatatttaaggtatacaacatgatatatgtatacattgtgaagtgattgccacagtcaaactaatgaacataaccatcacttcacataacnatcttttgtgtgtgtggtgagaacgcttaagatttactctcaacaattccatgtttacaaattattaactataggtcccatgctatatatctccagaactaactcatcttacaactgaaagtttgtaacctttgaccaaaatcctcccattcccccttaccatagctcctggtgactattattctactctgtttttttaattctgcctctttagattccacctataaatgagatcatgcatgtttgtctctctgtgtctggcttatttcaactaatataatgtcctccagattcatccacattgtcacaaatgacaggctttccttttttaagctgaataatatttcattatgtacacacacaccccccacattttctttatccattcatccattgacagangcttgggttgtttctatatcttggctattgtgaataatgctacagtgaatgttcagatatctctttaagataatgatttcagttcctttggatatatagccagaaatgaaattactggatcatatggtagttctatttttagtttttttttgtttttttaggaacctccatactgttttccataatggctctgtcagtttacaatctcggcagcagtgtgcagtggtttcttttcttcacagcttcaccaacacttgttatcatttgactttttgataatagccatcctaacaggtttgagatgacatctcatgcttttgacttgcatttccctgatgatttgtgatgttgagtacatttttatatgcctgttggaaaaatgtgtggtcttctttggaaaaatgtatattcaggtcctttgcccattttaaaagtaggctatttgtaggtttttgctattgagttgtatgagttccttttgcattttggatattagcttttcttgatgaatatatggcttgcaaatgttttttcccattccataggttatcttttcattttgttgagcatgttgaaacttttcagtttgacgtcctactcatttatttttgctttatttgcttatggttttgttgtcatatctacaaaatcattaccaagacccatgtcaaggagctttctcccatgctttcttcaaggatttttatggtttcaggtcttatgtttaagtctttaatcctttttgagttgttttttcgtgtatggtgtacaagaatagagatttaagctttaaagagagaaataagacaggtattctagattgaaatgcaaattacacctgcatttttaagatgacactttaagaaatagacctcttgcagcagaacacttcgtgttcctggaacctgtagtgcttgtttattctttttagatatttaattgacagccaaatccagaagagatagctgctgaatttgtcactaattctgagtctgattctctcgtttctttgcataaaagtagtgttaatgctctgtgctcaaattagagcacctaaaccatgtttctgaaatacagtgtatatgaaattaaagtgtaagttgcagctagtataaaaaaagcaaatcattttattgtggcagaataatagtgacatcgtatgggtgggcaaaaagccacaggaccctgattaggaaaatgattttagtcatgaaaaaagtatgctttctgagagaatggtccttcatcttttataccctagttaatttttttaaagggaagaaagccgatgtgcatttttacagttntatatgaagagtaagctgatgatgggtttcttttaaggggactcaacatagagttatcagatttggtaagtccattatgggcttaatgtagccttcactgctgagctcttattatagggcacttgttttcaggaggtagctggaaattggggggcttatatcaagttcagaaatagacatgactaatttaaaatgttagaagtcaggatactttttagtaaacattgtttttaaaaatctgttgtacgttttgggattctaactcatttgtgtttggtaagaattcactggtgcctacatatccagccattttactaattttacatacgtcatatttagatggtgtttacagtaactgctgttgctttaatttaggtcttgtactgcataggtgccatcattggaacatcaattatttagtgttaatatgcttagatgctagtaccagttgtgtaccgagtgtataactggctgatagaaaagtgagatgtggaagtgtcataaatatatggtgttcagcttattttggaattaggacaatggtttttttgttttgttttgtatttttcatgtatacttcctagatcaactctcagatctttaatttgtgcatagggcttcctgaggatgttgctcttactagaggtaattgatcagttttcattgatggctccctcataaagtggaagtttaaaacctaatctgtggaagccacgaaacagtttccctcagccagtcatggtggctcacacatgtaatcccagcactttgggagggcgagacaggcagatcacctgaggtcaggagtttgagaccagctgggcaacatggtgaaaccctgtctctactaaaaatacaaaaattagcctggcctggtggtacgtncctgtaatcccagctactcaggaggctgaggcatgagaatcgcttgaacctcaggaggcagaggttgtggtgagctgaggttgcgccactgcactctagcctggttgacagagtgagactctgtctcaaaaaaaaaagttttcctgctctcatttgctgtttcatcctaagaaacttgagaaatagactactttaaatattacagtgtatataaatgtgtaatttcataactctgcaaaagaaaacccagaaaaaataattttttaaactttctttttggggagggaggagttagtgaccccaatctgttattttacaaaatgggcaaacattgccaatctttctgaagtttgaaatgcagaatttgaagtttctcactgccctgcgttctagggaaagaaaaccattctatactagaaaggtgttatttaaaaagtttgatacccagaaaaattaattatttcattagttaccataatgcctgtgagttttttgccactttgatttaactgacattgacatgtctttgtgttagtgttgcagcttctcagtttttatattctacttcattggttgtaatttagtctcagatgatttcctataggatgtaatttcctgcatagtatatgggttctacttagcctgataaatgatctttccaacctcctggaagcactatatgccaaagatattctgatattttctaaagttttaaggaaaattattgggtatgtagttattagtccatggatttattttagtaattgtcattgtttcaccttttctcaagtttattgttcagcttaaggatattttcatttaggatatatagcccagacactgggttataattataatcaatatgtaagtatggttataattataatcagtatgtacgtataatcaatatgtaagtaatcatttgttatcaacctcctcattcctgttcttaatagctaacattttttgagctgttatactactgtgctaggcttctttcttaaattcctacttcacattaattatctcatttaacatttggctctgaggtatattctattaatatttccattttgcagatgagaatataaagtcgtagaagtttaaatacatgcttatttctcacagtaagaaatgctgagaccagcattaaaactcagctcatctggctgtagaacctgtactcttaagtactattttatgttgcatcacataatggtacatgatctttttttggttagtgtaatagttatgatgcttgaaaattttattgtctaccctttgtaatttattaaatatggatgtttccttgtgttgtcaagtgtgtttattatgccatgttaactttgtcatagtctcatcattatttttcacccagattttatgaagaccctttattattaaaataattttcacatatattctgattaatacaacagtggataccattttttgagtatt

SEQ ID NO: 69169 - DNA, 168 bp, Homo sapiens
ccagcttcaagtatagagggcattactaaaggaggccttctctgcctgcagcctccctctaagttgattgagggttgctacttctataccccacagcaaagcagtttaatgactgtgaagtaaaaatctacgcttaaccaagaaaggttgtgagcctgctggcgcaaa

SEQ ID NO: 69170 - DNA, 566 bp, Homo sapiens
cgctggaggactcatcgatgctagtggggacggggtcgatggaggctttcacatcaatcaccgtgatcccttcccggaagactctggctttgcctccgatgctctgaatacagcccatggcatacaggagcgctctgatctccagggaaggccagcagtcacagaaaaaaccaggcattgaaaggacagaggctgcaggacccagtacagacggcgctgctctccaatctcaactctcaagaccgatatccataggatagaaaactcactgagtagactggggttgcatatatcactaccgcggcctgtttataaataaggattctgctgcatttcatgagccctgggctctctcttcttctcctcgcagtggacaaaaatcaccgatattctttgggttaaaaaaagtttgtagtttaatgaataattatgcggttctgacatccagcccttctgtgcctcacacgcggggacggcagctcgcagactctccctgaagtcttcggaggaagcaggcgagcgccggcagactcataaataaggaaggctctgtccccgcgcggccg

SEQ ID NO: 69171 - DNA, 316 bp, Homo sapiens
cagagtataagtgccctttgtatcttgcactgtgagttttctacaaacataaacccttgtttaggccaaggcgtgaatacaacttgtcggtcccaaaccaacatcaatatcacgtgggaacttctgagaaatgcaagttgacacgagacctcaaaagtcagaaattctggggttgggacacagcactctgtgttttaccggtgattctaatgcatggtcaactttgagaaaccctaaagtgtatgtttctaaaaacaaccgtggttctaaatgtaacaaagatgtgtcctgggtaatgtctaaagcaccaaatcct

SEQ ID NO: 69172 - DNA, 349 bp, Homo sapiens
tggaggactctcctattatagccatcaaactcctgagtctgctacacaaggcccccccaacataagccctagatgaagatctgctaccattacagccagtattacctggcccttgcctacctctcaggtcttggcaatgtccaccttgctttttttactttaaatagcatcatttcgtgctcccccaggacactgtgcagcttcgcacctccaagcctttgcttctgcatcgcctgacacttggagcacccttctccactttcagattgagacttcggaacactttatcatcagcctatctgtaaagacttccttgctggtccctcccatcgcagaataaacagcctgc

SEQ ID NO: 69173 - DNA, 287 bp, Homo sapiens
tgaatattgttaataatggtggatccatgagttaaagtttacaagtttttaacataaatgacagcaaattcaacgccttccatcctgaaattagaaactgaccatgtacaattcctggttggttcatttatagcatttatatttgattttttaatattttattttcataaagaaatactgagccaggcatggtggctcacgcctgtaatcccagcgctttgggagtccacgcaggtggattacttgaggtcaggagttccagagcagcctgaccaacatggtgaaac

SEQ ID NO: 69174 - DNA, 338 bp, Homo sapiens
caccgggcctggccaaacacttttttataaaaacaattttccttgttttttcagtttttaattactctcctcctccaaatctggaattgagtcatagtttgcgcatagagctgaatatagacctggtgacttccaactgtaatactatcacttataggtaatagtaataataataataataataataacatagcagtagtagcagcagtgacagtagtggttacatcttttgggtatatactgtgtctgcacggagctaaattctcattctatgttcactttccttgtttcttcctttttaaattgcccttcacccaaaacaaaatctggaattgaga

SEQ ID NO: 69175 - DNA, 320 bp, Homo sapiens
gtttagtgaactagaatagttttccagagaactgagtgtcaattttaatgtttttttcctgatactttatgaaacaccagaggcatctagctgtgaatcccaaggacataagggtaacaccattcagggacatgcctgtattctggatgccttgttttcccttttcataccccgaacagactttgtgttatttatccgaatgccagcttccaggaggctgaggcaggggaattggttgaacccaggaggcagggcttgcagtgagctgagatcgagccactgcactatggcctgggcgacagaacaagactccatctcaa

SEQ ID NO: 69176 - DNA, 313 bp, Homo sapiens
gttgatttgattggcttttactttcaatttgcatgggcttaaaatggcaagaaaatcaacactggttaagtgaagagaacaagagacaaaacagtatttaaaatacccaactagggagggaaaaaatgaatatgtaaacatatacacacaaacgaacacgttcttgcacatacatttgcatatacttgaaacttttctcgaaaaacacccaagaaactatcatcaacaaccatcatcaataacggctacttctgggaacaaagggcagggtgggaacatactaaaacttttatttttccctttatattcttct

SEQ ID NO: 69177 - DNA, 392 bp, Homo sapiens
gatgcttaataccatatatcttgtaggagttggaaccaagtcctgtgcctcccagataaagatattgggaggaggaaatgtgggcagagaatctgcgagaagtaatggggatggagaccagaagagatgagctgtttttgtcacatgggtggtgtattagggttctccagagggagagaactaataggatagatgaatgtatgaaggggaatttattaaggaggactgactcacatgatcattaggtgaagtttcacaataggccgtctgcaagctgaggggcaaggaagccagtccgagtcccagaacctcaaaagtagggaagtcaacagtgcagtcttcagtctatagctgaaggcccatgagcccctggcaaactactggtctaagtc

SEQ ID NO: 69178 - DNA, 574 bp, Homo sapiens
gcccagttaattgttgtacttttagtagagatggggtttcgccatgttggccaggctggtctcgaactcctgacctcaggtgatccacctgccttagcctcccagactgctgggattaaggcgtgagcccccgcacccggccccaaaccctttctgaaagatgattctcccactggcccgaataactgaatatggacaaatgtcagctcagcctgcagcactgtaggggcagaccaccacggtggaacagagtcccgagctggcagcgtctgggaactgcaagtgtccctagccaacactggccagaacggggaccctggccctgcaaaggtaaggcactgagctctgtcaataaccagtgggctcagaagaagaccccaagatgatggaccccaaaaaacaaccctcagttacaacctcctgagagcccttgaggctgtggtaccctggctcctgactcacagatcctgtgagataataaaatggtgctgtttcagctgctaaatgggtgatttgctatgaagggcagaaaacaaagggaagcagtgtgaccagcaagagcggccgctcactc

SEQ ID NO: 69179 - DNA, 513 bp, Homo sapiens
ccctatattttttttctaaagaataaacactctggagtttcccacccagttaggtgtagcggattttaaaataaaccggccccaaaccctttctgaaagatgattctcccactggcccgaataactgaatatggacaaatgtcagctcagcctgcagcactgtaggggcagaccaccacggtggaacagagtcccgagctggcagcgtctgggaactgcaagtgtccctagccaacactggccagaacggggaccctggccctgcaaaggtaaggcactgagctctgtcaataaccagtgggctcagaagaagaccccaagatgatggaccccaaaaaacaaccctcagttacaacctcctgagagcccttgaggctgtggtaccctggctcctgactcacagatcctgtgagataataaaatggtgctgtttcagctgctaaatgggtgatttgctatgaagggcagaaaacaaagggaagcagtgtgaccagcaagagcggccgctcactc

SEQ ID NO: 69180 - DNA, 275 bp, Homo sapiens
tggccatttatatgtttcaacatgagtctcctcggctagaccgtgagcttgttgggggagggaagaggtctgtcctgtccatggctgatttccagctgggtgctcagcgcgcagttcctgtttgctgagtgcaggaaggacctcagccctttccccagggacccgggaacccatgagctgaggtcctggtttggggccattgccacttgtcccctttccatcccgtccattctggggaggggctgcctgtgccatcaggggattttgcatctttt

SEQ ID NO: 69181 - DNA, 763 bp, Homo sapiens
gacatcttttaacttactctgaaatgtttttggggggagtaaggtactttttacagtctactctaccagctgagctgtcaaagtttgcatataagttacttttttaaaagtgcatagctccatgacattttacatataaatacactgcggtgaccactatcaagagcaagaacatatccataacccccaaaagttactcatgtacctttctagtcataaatacccttactacacccctgagtaatcattattctggcttttctctccttaggttagttttgattgttcttgaattttttctgttttggagatggagtcttgccctgtcaccgaggctggagtgcagtggcatgatctcagctcactgcaacctctgcctcctggattaaagcgattctcctgcatcagcctcccaagtagctgggattacaggcacacgccaccaagcctgcctaatttttgtatttttagtagagacggggtatccccatgttggctaggctcgtctcgaactcctgacctcaggtgatccctcccctccctggcctcccaaagtgctaggattacagacgtgagccaccacacccatccttgaatttaatttaaatgcatttatacagtcacacagcacgtgctcatttgtatctcacttctttcgttcatctattttgagagtgtatcagtagcttgttttttgttgtctttttaaaaaaattgtttagagtattccattatatgaataaattacactttaaaaatatat

SEQ ID NO: 69182 - DNA, 444 bp, Homo sapiens
caaaaccctgtctgtacaaaaaatagaaaaaattagccgggtatggtggcatgcacctgtggccccagctactcaggaggctaaggtgggaggactgcttgagcccaggaaggggaggttgcagtgagccaagatcgtgccaccacactccaacctgggtgacagacagagaccctgtctcaaagaaaaaaaaaaggcaaaagatctgaacagacatttcaacaaagtagatatacagaggacaaataagcacatgagaagatgctcaacagcattagttattagggaaataataagtagcttctcaaaaagttcaacctgtgcctattgtatgacccagccatttcattactaggtatttacccaagtgaaaaaagcccaatcaaagacttgtacacaaatgttcataggagctttatttacaatagtccacaactgaaaaaa

SEQ ID NO: 69183 - DNA, 4117 bp, Homo sapiens
aggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttggatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccaaaacacagaagatttggactgcgtatctcgaggctataatgaaggttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagatacctgaaattcctgcagatgttgtgggtgcccttctgttcctggaggattatgttcggtacacaaagctacccaggagggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctcttaaatgctgaatgtaactgttatgtataaatccatttagttttatgttctaaagaactatttgtgcaactccagattttcagtaaaatagtattactagtacccaaaaaaaaat

SEQ ID NO: 69184 - DNA, 928 bp, Homo sapiens
aatttagtcttctcagggctttgcccaagaacagttcaggaatgcatgcctctgaaggccttcctgctcttccccttctggccttggtatctcattctcattcctgccctcccctacctctccaaccccatcacttgccagccatcctgttcttccttgttggtcatcagttaatgaagtgtattaggtgacctgagtacttgtcagtacttcccagaggcaagaacattcctcgcagatcaaggtacctttaagagccaagaagctcagatttggaggcgggagagctgtactgcatcccctcaaatgttagcagtgccaagaaatgagacgctagtctagggggcaccacaagcagaaaggggctgtttcaaggagtcgtccgcccatgggagtctcctcttctattattcaccttgctccaaggatatcttttcttttacgtatgaaaattttgtaattgttcaactataacaccatgaataatttaattctttaatttttcaggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctcttaaatgctgaatgtaactgttatgtataaatccatttagttttatgttctaaagaactatttgtgcaactccagattttcagtaaaatagtattactagtacccaaaaaaaaat

SEQ ID NO: 69185 - DNA, 1883 bp, Homo sapiens
tcgttaccggagtggagatgtctgagggactatgctcagtaggccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccaaaacacagaagatttggactgcgtatctcgaggctataatgaaggttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagatacctgaaattcctgcagatgttgtgggtgcccttctgttcctggaggattatgttcggtacacaaagctacccaggagggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctcttaaatgctgaatgtaactgttatgtataaatccatttagttttatgttctaaagaactatttgtgcaactccagattttcagtaaaatagtattactagtacccaaaaaaaaat

SEQ ID NO: 69186 - DNA, 4072 bp, Homo sapiens
aggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttggatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccgttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagatacctgaaattcctgcagatgttgtgggtgcccttctgttcctggaggattatgttcggtacacaaagctacccaggagggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctcttaaatgctgaatgtaactgttatgtataaatccatttagttttatgttctaaagaactatttgtgcaactccagattttcagtaaaatagtattactagtacccaaaaaaaaat

SEQ ID NO: 69187 - DNA, 970 bp, Homo sapiens
tacatttatctgtatctttaaaaattgctacaataatatatgttaattgagtaattcaaaagaaccagtaatgataattacaaaatttagtaaccgttttattggttttgaatccttcagacccctggaatgccctaccaatcctgtggctaattcaaaatatggcccagaattgtcattccctccaaaatatcatctgccagcgagaatatgggccccaaacattttgaccttcacagcgttggtatttaatgaatgttgctgaaggcaagtacttcatatggtgttgcaacttgttcccttgcaggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagatacctgaaattcctgcagatgttgtgggtgcccttctgttcctggaggattatgttcggtacacaaagctacccaggagggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctcttaaatgctgaatgtaactgttatgtataaatccatttagttttatgttctaaagaactatttgtgcaactccagattttcagtaaaatagtattactagtacccaaaaaaaaat

SEQ ID NO: 69188 - DNA, 4117 bp, Homo sapiens
aggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttggatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccaaaacacagaagatttggactgcgtatctcgaggctataatgaaggttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagatacctgaaattcctgcagatgttgtgggtgcccttctgttcctggaggattatgttcggtacacaaagctacccaggagggttgctgaagcacatgtgcctaatttcatttttgatgagttcagaacagtgctgtaactgtttttcctacttcttcaatggaaggattgtccttagatcttcccaccatcacaaatgaatttgaagatgaaaagaaactcagttgctcatacaactgcattttttctgtctattatgggaaacatcagacgttctgagtaagatatatctcatggcattagttaatataactgatattgtttaaatcatggtattacatgcaatttatatcagataaaagcagaacacatttttgtactgcctctccccctcctgaatcgtactgcctgtgtctctacccctttcgttcttggctatccagcgccatttgaaaaaatacaaattatcagtaaaataattaacccgctagttctagtcgcga

SEQ ID NO: 69189 - DNA, 3666 bp, Homo sapiens
aggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttggatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccaaaacacagaagatttggactgcgtatctcgaggctataatgaaggttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagataattttgctgagttttcagggtttcttctgtaaataaaacataatattt

SEQ ID NO: 69190 - DNA, 3699 bp, Homo sapiens
aggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttggatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccaaaacacagaagatttggactgcgtatctcgaggctataatgaaggttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacttcaatacaacaaaaatctgggaatggtctgccgaaaaccgaccgacccggttgattggccaccacttgtcctgggactgctcactctgctgaagcagttccattcccggtacaccgagcagttcctggcgctgattggccagtttatctgctccacggtggagcagtgtacaagccagaagatacctgaaattcctgcagatgttgtgggtgcctctgtctgagatattcgtacacagctaccagagtgctgacgaattctatca

SEQ ID NO: 69191 - DNA, 3835 bp, Homo sapiens
aggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttggatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacagaatttcctcagtatgtttcagaaaattatcctgagagacagaactgttcaggacactttaaaaaccctcatgaatgctgtcagtcccctaaaaagtattgtcgcaaattcaaataaaatttatttttccgccattgccaaaacacagaagatttggactgcgtatctcgaggctataatgaaggttgggcagatgcagattctgagacaacagattgccaatgaattaaattattcttgtcggtttgattctaaacatctggcagctgctctggagaatctcaataaggctctcctagcagacattgaagcccactatcaggacccttcacttccttaccccaaagaagataacacacttttatatgaaatcacagcctatctggaggcagctggcattcacaacccactgaataagatatacataacaacaaagcgcttaccctattttccaattgtaaactttctatttttgatcgctcagttgccaaaacatgaaagactgtgaaaatgaatctggaggtgacccaagcattgaattcaacaatccaggctgggtgcggtggctcacaccgggaggctgaggtaggcagatcacctgaggtcagggaagaggttgcagtgagctgagatcacatcactgcactccaacctgggcgacagagagactgtctcaaaagaaaaaaaaaattgtgcttcaggccctgtgtagaacaattggaaattatggaaaagcagaggaaacaacttggtattaagcagtatagtgtggtggctcagagcaaattcgcctctgctgctgaggctggttacgtcatctctccgtgcctcagtttccctatttgggataacgtattacctagtgaatagcggtgacttgaggtaatccgtgaggg

SEQ ID NO: 69192 - DNA, 2990 bp, Homo sapiens
aggggcggaagtcggggtctgacccgctccaggtccgggactgcggatagaagaggaccgccgccttgagggaggggtggaaactgggtgccggctccgcgcgcgacctccggccctgcgcgtgcgccgtggcgcggcccggctgacaggttctttaatggaggagccaatctctctgcacacctggtttcatctaataatatacagacaccagctctgaggccagttaatcatccccagtgtccaggcacagagtagtcggtccgcctcacaatgttggactttctagccgagaacaacctctgtggccaagcaatcctaaggattgtttcctgtggtaatgccatcattgctgaacttttgagactctctgagtttattcctgctgtgttcaggttaaaagacagagctgatcaacagaaatatggagatatcatatttgatttcagctattttaagggtccagaattatgggaaagcaaactggatgctaagccagagctacaggatttagatgaagaatttcgtgaaaacaacatagaaattgtgaccagattttatttagcatttcaaagtgtacataaatatattgtagacttaaacagatatctagatgatctcaatgaaggggtttatattcagcaaaccttagaaactgtgcttctcaatgaagatggaaaacaacttctatgtgaagcactgtacttatatggagttatgctactggtcattgaccaaaagattgaaggagaagtcagagagaggatgctggtttcttactaccgatacagtgctgctcgatcttctgctgattcaaatatggacgatatttgtaagctgcttcgaagtacaggttattctagccaaccaggtgccaaaagaccatccaactatcccgagagctatttccagagagtgcctatcaacgaatccttcatcagtatggtcattggtcgactgagatctgatgatatttacaaccaggtctcagcgtatcctttgccggagcatcgcagcacagccctggcaaaccaagctgccatgctgtacgtgattctctactttgagccttccatccttcacacccatcaagcaaaaatgagagagatagtggataaatactttccagataattgggtaattagtatttacatggggatcacagttaatctagtagatgcttgggaaccttacaaagctgcaaaaactgctttaaataataccctggacctttcaaatgtcagagaacaggcaagcagatatgctactgtcagtgaaagagtgcatgctcaagtgcagcaatttctaaaagaaggttatttaagggaggagatggttctggacaatatcccaaagcttctgaactgcctgagagactgcaatgttgccatccgatggctgatgcttcatacagcagactcagcctgtgacccaaacaacaaacgccttcgtcaaatcaaggaccagattctaacagactctcggtacaatcccaggatcctcttccagctgctgttggatactgcacaatttgagtttatactcaaagagatgttcaagcaaatgctttcagaaaagcaaaccaaatgggagcattacaagaaagagggttcggagcggatgactgagcttgctgatgtcttttcaggagtgaaacccctaaccagagtggagaaaaatgaaaaccttcaagcttggttcagagagatctcaaaacaaatattgtctttaaattatgatgattctactgctgcgggcagaaaaactgtacaactgatacaagctttggaagaggttcaagaattccaccagttggaatccaatctgcaagtatgtcagtttcttgccgatactcgaaagtttcttcatcaaatgatcagaaccattaacattaaagaggaggttctgatcacaatgcagatcgttggggacctttctttcgcttggcagttgattgacagtttcacatccatcatgcaagaaagcataagggtaaatccatccatggttactaaactcagagctaccttcctaaagcttgcctctgccctcgatctgccccttcttcgtattaatcaggcaaatagccccgacctgctcagcgtgtcacagtactattctggagagttggtatcctatgtgagaaaagttttgcagatcatcccagaaagcatgtttacatctcttctaaagatcataaagcttcagacccacgacattattgaagtgcctacccgcctggacaaagacaagctgagggactatgctcagctaggcccacgatacgaggttgccaagcttactcatgctatttccatttttactgaaggcatcttaatgatgaaaacgactttggttggcatcatcaaggtggatccaaagcagttgctggaagatggaataaggaaagagcttgtgaagcgcgttgcctttgccctgcataggggactgatattcaaccctcgagccaagccaagtgaattgatgcccaagctgaaagagttgggagcgaccatggatggattccatcgttcttttgaatacatacaggactatgtcaacatttatggtctgaagatttggcaggaagaagtatctcgtatcataaattacaacgtggagcaagagtgtaataactttctaagaacgaagattcaagattggcaaagcatgtaccagtccactcatattccaatacccaagtttacccctgtggatgagtctgtaacgtttattggtcgactctgcagagaaatcctgcggatcacagacccaaaaatgacatgtcacatagaccagctgaacacttggtatgatatgaaaactcatcaggaagtgaccagcagccgcctcttctcagaaatccagaccaccttgggaacctttggtctaaatggcttagacaggcttctgtgctttatgattgtaaaagagttacaggtgagccttttgactttcatgcctgttttctgccaccctgggggagaggc

SEQ ID NO: 69193 - DNA, 390 bp, Homo sapiens
gcccagaaatatttctttttcccctttttaacattatctcaatagcagatagagagggaagcacaaagatagaatcctggagagggcagactggaatgtggtttactgagaacctcaaagaaggtaaattcatcttcaccacttacaaatttgggccatggagttggccagtaaatcagtgccctaccaaagatgaattcctatatttttagcgatggtagctgactccctatcaaccaaaggctgggtgtcagttggagtatatacttcttggcaaaaaactacaaccttaacttaccaagatttagttcctagccattttaaatctgcttaacagaaagctcagctcattctccagacagcctcagatagctcattgatggtggccta

SEQ ID NO: 69194 - DNA, 954 bp, Homo sapiens
tccaacataatacaacaaaacacacccgcgtctaatcctattatagcgcactcgtcaatatccggcctatggtaacatctccgttttcagaagctcagaaaagtaagctgcttgctcaagaatggacggcttcaaggtggcagagctggaagtttctaactcactcacctcatactcagacctgcactgtttttcaagacagtcaatatttcaggccatctactgattggatgaggcccaccagcattctgaaagacaaggaatctgagacctggctgggagaagaggacttgcctaaagttatcccacacagcaaattagttggaaaaccaggatagttgagtaaatatcctggagcccagccaagtaatgaagccagaattcagaaagctgttttggctagatcttggatttttacaataaagggtctgtaagggatatttgtgaaaaatgttgacacttgacggctgtcctgattcattcagctacctaggttatctctgcctctctttgacttgtgttttgtcttttaagatggcagtcttgctcttttgcctgggctggtcttgaactcctgggctcaagcagttttcctgctttagcctcctgagtagctggggctacaggaggacatcactgtgcccagctctctccgtatctttgactaggttattttacaaccccatacgatagaaatgaagttatagaaaactgataggaatacaaataattattatccatggaaatgcaaattggatctaatggaatgaaactgattttttttccagcagatagtgaccacctttgtatccttttgtaaattcatttcagcattccatatttgactaaaaatgtgtgacactcccaatttgcttttgaattcattgtaatatctaccaattccctcattaattaatgagttaaataaagcctttggcatgtatttattttgta

SEQ ID NO: 69195 - DNA, 941 bp, Homo sapiens
ctctcaatcaaactaatttccagctttgattaataatcacagcgtaattcggcctatggtaacatctccgttttcagaagctcagaaaagtaagctgcttgctcaagaatggacggcttcaaggtggcagagctggaagtttctaactcactcacctcatactcagacctgcactgtttttcaagacagtcaatatttcaggccatctactgattggatgaggcccaccagcattctgaaagacaaggaatctgagacctggctgggagaagaggacttgcctaaagttatcccacacagcaaattagttggaaaaccaggatagttgagtaaatatcctggagcccagccaagtaatgaagccagaattcagaaagctgttttggctagatcttggatttttacaataaagggtctgtaagggatatttgtgaaaaatgttgacacttgacggctgtcctgattcattcagctacctaggttatctctgcctctctttgacttgtgttttgtcttttaagatggcagtcttgctcttttgcctgggctggtcttgaactcctgggctcaagcagttttcctgctttagcctcctgagtagctggggctacaggaggacatcactgtgcccagctctctccgtatctttgactaggttattttacaaccccatacgatagaaatgaagttatagaaaactgataggaatacaaataattattatccatggaaatgcaaattggatctaatggaatgaaactgattttttttccagcagatagtgaccacctttgtatccttttgtaaattcatttcagcattccatatttgactaaaaatgtgtgacactcccaatttgcttttgaattcattgtaatatctaccaattccctcattaattaatgagttaaataaagcctttggcatgtatttattttgta

SEQ ID NO: 69196 - DNA, 1204 bp, Homo sapiens
tgaattcagacactttcagtttagaggataatgccctctgaacaacctcaggccaaaagggcagagacagagaagcctctggaggttcggaaggacagattcatcagacggcagagccggaagcgattttacaccccttctgcaggagtgagaggagtagctgtttgacccccgctgcctcagctgaggccaaaaggcacggctgatttccacttaaggatgtcaaagaggtcagatggataatgtgctgatgtcataacaagattcagagggtggcacatctcacacatgagcatgaacacccaatcatcatgttcatgaactgcaaaaggatctgcagaagctcagaaaagtaagctgcttgctcaagaatggacggcttcaaggtggcagagctggaagtttctaactcactcacctcatactcagacctgcactgtttttcaagacagtcaatatttcaggccatctactgattggatgaggcccaccagcattctgaaagacaaggaatctgagacctggctgggagaagaggacttgcctaaagttatcccacacagcaaattagttggaaaaccaggatagttgagtaaatatcctggagcccagccaagtaatgaagccagaattcagaaagctgttttggctagatcttggatttttacaataaagggtctgtaagggatatttgtgaaaaatgttgacacttgacggctgtcctgattcattcagctacctaggttatctctgcctctctttgacttgtgttttgtcttttaagatggcagtcttgctcttttgcctgggctggtcttgaactcctgggctcaagcagttttcctgctttagcctcctgagtagctggggctacaggaggacatcactgtgcccagctctctccgtatctttgactaggttattttacaaccccatacgatagaaatgaagttatagaaaactgataggaatacaaataattattatccatggaaatgcaaattggatctaatggaatgaaactgattttttttccagcagatagtgaccacctttgtatccttttgtaaattcatttcagcattccatatttgactaaaaatgtgtgacactcccaatttgcttttgaattcattgtaatatctaccaattccctcattaattaatgagttaaataaagcctttggcatgtatttattttgta

SEQ ID NO: 69197 - DNA, 493 bp, Homo sapiens
cccccctcaaaaaaaagttttttcttaattaaaaacaaaaatactttagggtgatttgcaatataattttccaaatgtctcagggattataaatacagacttgcactattatgacgcctctagttatgtatggctattgaagtaaaattaaagactcagatttttttatttgcactagccacattctgcatgttcaaccatcacatttgtctagtggctaccacgtagaacagtgcagatgtagaacacttccatcaccacataaagtcctattggactgcaccactatttaaagatctgagctgaaattgtactgactccagaatctacaatagggcattttgatggtatttaaatagaaatctaggccaggcaccttggctcacactattaatcccagcactttgggatgctgaggctggaggatcgcttgagcccgggagttccagaccagcctgggcaatatagtgagacctcgtctctacagaaaaaa

SEQ ID NO: 69198 - DNA, 845 bp, Homo sapiens
gagtggtaatagagaaatatctgcaaggacagcattgaactcagaactctgtgcaacgatgaaccctgaagctaattatgtaaaaagagagtttggccattatctcagaatagagttagtcggaatacacagtcttaattattgatacacaaatatgctgaagtaataccaagagaaaaaaaagtggacatgtttaggaaaattagagggaattgcaatactgaagaaaagaatatcatcctaaagacctggaaacttattgccctgaaaattagctgctgcaggcttcagaggaaatttccagaaatgttggtgtccttagtggcataacagagaatctgaactcagtaaagatagagtagaaatatacaagtagagaagagtctctaaagtgaaaagagaaatagatacaacaaagaaggacttcagggagctctgaaatactgtatcaaaataaatgcaataaaaagtaacactgaagaatataaaataattgatagttaatagataaacttgatctgatcttaaatgtatctgaaaaggataatgagatggaaactaagaaagaacagatatgaatatcagaggatggaggtccagtgtgagaattaaaggtgtctctaaggaaggtgaaagaacatttggcatagaatcaatgatcaaagacattaagaaactttctctgagttaaaagtatatggtcactaagttttaggcaaaaccagtattaaagcaaccttagaaacaggttagaaagaagcaattaaaagcatgcagaaagaaaaattctggttatctgcaaaaccaaaaagggagggtggatacagagctctgcaacgtcgaac

SEQ ID NO: 69199 - DNA, 2265 bp, Homo sapiens
gtaacttgacagcacaacagagctggtgagtggaagttggaattgaaccagctttaggtcctcaattttcaacaaatagaccatattttcagtttccaaggccttctgctaaggctgaaagaaggtagattgaaagaggttcttgtcctcaaactactcacagtggtaatacttgaatttcttctacctggctcagttgttggtcaagactcttgctcctcttggtgcagtccagagaccagcagcattggcatcatccagaactaggcttggatgcttctcaaacattaatgtggacttcgaatcacctgggatgtctttacaatgcagactcttattcagtaggtttgagatggggcccaagatgcttttctgacaagtttcctggtgatgcaatgttgctgttggggaaacctccatttggtgagttctacaatttgtcttgtttttcagtgtgtctaaggtaggcccagtataccttactgggttccttactgagtcgtagctttcctccaattctgatgttctcttgattcaaatagaagagctttcaccttggcttcttggctatggccctctgctgccctgggtcccaacctacatagctatggccctgcctgcctgcttatctctagcttagactttcgagtccacactcccagttaccagtgatgttctaacatcagcctggttgaggatcttcattccctcctcttcatcaaaaccaactgtgaagcccattaaaaacctgtaagccttctaggtctacaaccatagattttaattctggggctagtctttggaattttattttcatttacaaagttttatagttgattctgatgggtgtcacatactgagaacaacttccctaggggcccctgctatgctctgacctgatgggaacctcttggaaagtaatattggcatggcttgggttcaagtttgcaatacactgagaactttttctctatgcctctgtgttagcaatgagagcacagcatggagagaacttaaaactttactgaactagtttcagaaggctttgctgagtgattggcatttgaattggatagccattgaatgaagaggtcctttgttcaggccaaaggagtggtatatgcaatgatagttaaaagtgagaagtgccttaagtaaacatccatttggacaaaagtgtttgtttaacacatggaaaggagaagtaggagataaaattataaaggtaggtaaaagcctcacttttagaacttcatgtgttacaccaaacagtatgtgctttattctacatattgtgaggattatcagagattaagatggaaagcaagctgatcagatgtgtgtctcagaaagataaccttggcattgaggaagatgaattcagtgaggcaagactgaagacaaagagaccagttaggtacgtgtggtaatagagtgtgagagatgaagagggatcctttccttgtgccatatgcctgggccctgaacctaagttcctctgtctcagacactgatgatgcttttttttttttacagttacatttcatagcaatagcctgctaagcctcttagactttataaatggcatggccttgagcattcaggtaactcaaagcttttatgagccatcagtggttcttacttctcctgattattttattttatagtgctgagacagctagctctagggttcttccctcaggagatacttagagtttttaaggtaattatttggtagaaaatcttctactaatggcctaagataaatttgaaaccagttaatgagcagctatatgaatccaatggttgggagagttgtgtctaggcctgttgaatgcactgctttgctctacctttggagaaagactttgcgttatccttgacctagcttgatttttttaggtactgcctctggatttgttccttttagagcgacagctccagtcagttgccttttaaaagtaagcgtagatgtggctgggcgcggcagctcacgcctgtaatcccagcactttgggaggtgttggtgggtggatcacctgaggtcaggggtttgagaccagcctggccaacatggagaaaccccgtctctactaaaaatacaaaaattagccaggcatggtggcgggtgcctgtaatcccagctactcgggaggctgaggcaggagaattgcttgaacctgggaggggaggttgcagtgactgagattgcaccattgcactccagcctgggcgacagggtaagactctgtctcaaaaaaaaaa

SEQ ID NO: 69200 - DNA, 168 bp, Homo sapiens
  misc_feature (63)..(63): n is a, c, g, or t
tacaagtgtaaagaatgtggtgaagccttcagtcagagctcaactcttacaaaacatataaangtctacactggagagaaaccctacacctgtaaagactgtaggaaagccttcagccagagttcatctcttacccagcatcagagggttcatactggaaagaaacca

SEQ ID NO: 69201 - DNA, 216 bp, Homo sapiens
gattcttaaagaatggacaatcaggttcttactgttttcaagacaattattctttagatccacttggcatagtctattccaaaattaataattcttccttttgaatcaaaacaaatttagaaattctaacatgatttacagtaacaagctctttttatctgctcatcagtagatagaaaatatgtgtttttgttttataactggcttttatatact

SEQ ID NO: 69202 - DNA, 375 bp, Homo sapiens
aaaacgcttctgtttggtgtctggaccctgctggccttgatcctttgcccagacccaggacccagtggaattgagaccttcttaaagaaaactcaggtgggcaaagggcctcagtggaaagagtttcttctggaggatgtcacagagaattccatcctgcagtgcttcttctcttgtgcagggattcaaaaggacacaagccttggcatcactgtgtattagccaccagagcaagtgatcctggagctgcagcctgcctgggtggctgtggacgaagccttcacagtgaagtgtcatgtacccagtgtagcacccttggagagtctcacccttgcccttctccagggtaaccaagaactgcatagaaagaacttt

SEQ ID NO: 69203 - DNA, 296 bp, Homo sapiens
cccgccaataccaaaatctgaggatgctcaaaactctatttatataatatggcatagtatttgcatacaacctacacacatcttctcatatgctttaaatcacctctagattatctacaatatgtaatactatctaaattgttgttataccatattgtttttattcatattattttttatagttgtactgttatttcttttgttttggaatatttttatacacggttgaatgtgcagatacaaagggtcatctgtattattctaaaattaaataaaactatatattatttgccttt

SEQ ID NO: 69204 - DNA, 440 bp, Homo sapiens
aaattaaggcagaaaaccaacaaaaagaaaaaaaaaaaaacgaagaaagaaaactcaagtcagtgttggccaagagggttgggagtcagacagtctcataccaggctggtagaaatacaacgtggaacaaccttttgtggggcagtttggcaataagactaatatgctcgtttcaaaagccttaaatgcacgtttgtgctttgacccggcaattccactttgggaaatttccccgcggggaataattaaggatgtgttcgcaaacttagccgcagaaggcactctataaatagttgttaaatgaagaagtaagtggtactcattgctgcattgtttataataatgaaaattccaataacggggaaaaaaatcaaataatgatggttctggccataaaatggaatcctttgcagccattaaatatgatttggtaaacacgt

SEQ ID NO: 69205 - DNA, 2981 bp, Homo sapiens
  misc_feature (278)..(278): n is a, c, g, or t
  misc_feature (893)..(893): n is a, c, g, or t
  misc_feature (907)..(907): n is a, c, g, or t
  misc_feature (916)..(916): n is a, c, g, or t
  misc_feature (931)..(931): n is a, c, g, or t
  misc_feature (973)..(973): n is a, c, g, or t
  misc_feature (1033)..(1033): n is a, c, g, or t
  misc_feature (1073)..(1073): n is a, c, g, or t
  misc_feature (2750)..(2751): n is a, c, g, or t
  misc_feature (2759)..(2759): n is a, c, g, or t
  misc_feature (2777)..(2777): n is a, c, g, or t
  misc_feature (2819)..(2819): n is a, c, g, or t
  misc_feature (2822)..(2824): n is a, c, g, or t
  misc_feature (2864)..(2864): n is a, c, g, or t
  misc_feature (2873)..(2873): n is a, c, g, or t
  misc_feature (2891)..(2891): n is a, c, g, or t
  misc_feature (2937)..(2937): n is a, c, g, or t
  misc_feature (2960)..(2960): n is a, c, g, or t
  misc_feature (2962)..(2963): n is a, c, g, or t
  misc_feature (2965)..(2965): n is a, c, g, or t
  misc_feature (2976)..(2976): n is a, c, g, or t
  misc_feature (2980)..(2980): n is a, c, g, or t
ggcagcgtccgcgggaggtgaggtggctgtggggacccaggtggcctcttccctggggccttgctaatgacggcaaaatccgggttctgccaaaatatatttaaaaaggtttattcctagtcagtatgagtgactgtggcccaggttattcagcctcaagaggtcctgtgaaagtgcccgagatggtcaggcttgcaggttaattttatacaattcagggagacaggaatttcaggtaaagtcataaatcaggctgagcagtgtggctcatgcctgtngtcccagcactttgggaggccaggagttccagagcagcctgggcagcacagcaagaccctgtctctacatgaaattagaaaaataaaaaaattagcggggcgtggtgtcccatgcctgtggcctcagctacttgggaggcccagtcagttgagtccaggaggtggaggctgtaaccagctatgttggctgcactgcacgctagcctgggtaacacagcgagatcctgcctccaaaaagaaaatcataaatcaataagagaaagatatacacgggttcctcccaaaaagctggtatatctccaaagggtttacacctcatgggggcacttagggattctttagtggacagttggttgagagacttaagctactgcctgaagactggaatcagaagcatgccagagttaaggggattgcgtagatcaaagttcttattatgtagatgaagcctcttagttggcaactctcagaatagatggtaaatgtctgttttcagttttttgggtttttgtgtttttgtttttgtttttagagagagtcttgctctgtcgcccaggctagagtgcagtggcgtgatctcagctcactgcaacctccacctcccaggtttgagcngttctcctgcctcngcctcctgngtagctgggactacnggcgcccgccaccacgcctggctaatttttgtatttttagtngagatggggtttcaccatgttgctgaggctggtcttgacttcctgacctcaggtgatccncccacctctacctcccaaagtgctgggattacaggcgtgngccaccgcgcgtcaggctggctgtctcttccagacctaagaaaggcttagaacaaaggaggtctggctacattaatggagattcgctgcagatgcaaattttcccactaaagatagctttgcggggctatccatttcaatctgttgcccctgtggcagccacttcaaaacatgtcaaagaagtatattttggggtaaaataatttccttcagcatctgctgtcatgtgatgctgtaccagagtcaggttggaaagtgagcctcattatataagagtaataaaactcatctgatgagattttatggtttctcgggcaggattccccaagcctcatacataggcatttgggcaagggaaaaaaggtgaatttagtcctcaccaggttggtagggcttcctcggttattggagtgggagtaacagcaaccattgggcccagcagtttttttaaatgtctctggggctgtggactgaccatccaaataactgattttaatcatttcattatggaaaaattgtcagcagaacccccaagtagagagacccatcagtcaagatatacctcatgaccttgcaagctaatctagcttgacccagatcccctcctaatctgtgcagattcattgaggaatgtcatagccatgcctactggttaagacatagtcctttacagtgagagttgaaacccaagctctatcactttcttggctgtgttgctttgagaaaggcatttaaatgttttgtgcctgtttcctcatctgaaattggtgggtaatagtcacttcataggacagttgtgaagattgaatgcagaaaaatttgtgccacgcctggaaccgtccctggcatatattaaattctaaaaaagtgttaaatattataatgaatatcaacacttccttattctggaagcaccgacaggatatgctgtgtttagtgttagcatcatgtcaggacagggtctgttgcgatgcccacactcaggatctgttcccaggaacctgcgtaaagttttcttctctggaagactttgggtcctttttttttaacaagaagaggctctaccctgggactgggaatttccaaggccacctttgaggatcgcagagctcattttagagccattttagtccccagctcctcttcctccactcccacgttacccgtgagaggactgtctgcagggtaagggaggacagcccaaccccaggtggggacttcttatgtattgccttcctgcagtgccttctctgccctaaaccatggtgggtttcctttgctaatgtctgacatcttgtgccctacactgtcccatctgaggctcagaacctctcagccggttctcatggggaacgttccccagatctgatgccctcattcaggacacttccatcattgtccctacatttcttctctcagtgctttattcaggctgctgcattcgtggtgcagaccaggtcttgtaaaaaattattcagtcagcatgtgctgagccattgtcctgtcccagggacagggctttatagtcattgccctattcatctcttcaaccaatgtggaagttaggaattggaatccccatttcacagactaagaagtggcgtgttaatcagttgaaataatttttacggcttggcgtggtggcccatacctgtaatcccagcactttgggaggccnnggcgggcngattacctgaggccaggngttcgagaccagcctggccaacatggtgaaacctcatctctnctnnnaatacagaaattagccaggcatggtggctcacgcctgtantcccaactnctctggagcctgaagcangataatcgcttgaatccaggagatggaggttgcagtgagcagagancatgccactgcactacagcctgngnnanagtgagactcngtcnc

SEQ ID NO: 69206 - DNA, 342 bp, Homo sapiens
ccatccaggaaaacatgacctcaccaaactaactaaagcactagggaccaatcccaaagagacagaaatatgtgaactttcagaccgaattcaaaaggaactcggttttgaggaaagtcaaagaaattcaaaataacacagaaggaattcagaatcttttcagataaatttaacaaagagattgaaacgattaagtagaatcaagcagaaattctggatttgaaaaatgcagttgacatgccgaaggatgtttcagtctcttaacagcagaattgatgaagcagaagaaagaatcagtgagcttgaagacaagctacttgaaaatacatggtcacagacaaa

SEQ ID NO: 69207 - DNA, 541 bp, Homo sapiens
ccccatgataaatggcatccagtagagggtactgatggtatgctctgcccatgaacttgctggttggatggacttcgaaatcctaaatacccactgtggtcccaccttttctagtggcattgatggaatagagccttccagcttaaggaagagaaagaagtagcatctctaacatctctcttttggacctctttatttctctcttaccgagatcaactagcatttcctcttgctgcagctgcacagcccccaggctcctggctttgtttatacaaacatgtgtggaatgctagggaccagcaggactggattccttaaaagccttagtagcttaaagggcttttacctgctatgtccaacacgtttattacggctgttctctgccaagagtttgaaattattagatatctcaattcccactggcattttttaaaattatttccagttaagccttcaattttaaaatgactcaccagcatcttgtcaaatctgtgtattttgaacatacttttaggtgaaatgtgtcattgtgtgtatctgg

SEQ ID NO: 69208 - DNA, 953 bp, Homo sapiens
tagatgaggcctcccaatattgcccaggtagcactcctggctcaagcaatcctcctacctctcagcatcctaagaagctgagagtacaggcatgagccaccgtgcccagctgtatctgcttcttcctgtatctgcttctttctctcacaaggcacagggatcccagggccaaacagcattaacaacttgccatgtcccaaagcattcactggtggtaccacaaagacgttacctaaggacactgaaaagacataagatgcatgaccagaaacttttctgaccagactcagaggcagagatttggcttgtgatgtggcacaacataggcattgtaccaggacagacatcacagggacctgcatctgcatcaggacagaggtgaactccaaagaactccactgagagactaccgtccacccagtcaccagtgagatgggcctgctctgtgacaggaacaaacagagatcactcttgcaaggtgaggtgattctaagacttgaatcaagagtaagaacgtgcaagaaggatgaggatgagacatacctgacagtaacaatacttgtcatcccctccacagaaggcacaggcaacatttccaagcaaaagcaaatgagatgctacaaaacagaggtaatcatccagaaaagctttagattgaatttcattaccctctaggtcttgcctaaacaaatagagactgggtctccttgcaccaaaagcaaattacatattgtaggtcaacagcctgccccatggaaagggtctctgacagagagctaagagattttttatctaattctgaaaagctaggtgaactctagacctcagttcctccctgcaaaattgtagaatactatccaattcatagaaatgctgtgataaatgtaatataacttggagggagaaaaaaggtccaactgcttgatagaaaagccattaaaaatataataatt

SEQ ID NO: 69209 - DNA, 416 bp, Homo sapiens
ttagctccatgattttacccatctgtcacaccctcctgggcatgtgacctccagattctgagttgaccctcatgtgggagagagatctgtgtttgagtgaagcagccctggaaactacctccttcctgatggaaacccttgatcttctcgggattggtttctagcctcatttgccttcatattccctctgtgctctttaccaccacccagctctgaatacggggacagggaggaggtggggcagggagattcaggatggctgacccctcatcttcctcatccatcattctctggttctcatagaattagggctgcactgggccttgggggattcagcccattcttttactatagagtagcacatttcctcatcagatttttaaagtgattgacttcaccattgaggaattatcttt

SEQ ID NO: 69210 - DNA, 105 bp, Homo sapiens
aagtgctttctgctactctaagaatctattcatgttctactggtatgctcaaataactgataattatcttgatttagaggaaatcatattagtatagcttttttt

SEQ ID NO: 69211 - DNA, 571 bp, Homo sapiens
tatagtatgaaaagtgaagagaaaaaacctattctaaacattttattaattgtcaataattattttaaaatatttaatatagtctcctacctggtccactggcatcaagctgccaaatttacacggtcactttgggaagccagctggcaggcaaacatggaaagtgctggctcctagcgtagtgagaagaccacagatagatggtaattttcttctttgttttatttttctttttcttctctccctctttttcttccctcttgcctttccctcccattgcccactttctttttttggctgccgaagatttattgcctttcagtacttatagatgatgttttcataagttctaatgaggtcccagcagtttttaacaataacaggacattactgttcctaagatatattatgtgttttccctcatctttctcccttgaatgaaatgcttagaagtaggctaacccccaattcccttccctttactatgataaatggctccattacttaatagggctaaatactctgctgtgacttttatactgctgatttgaataaaatcttacgaaaagca

SEQ ID NO: 69212 - DNA, 266 bp, Homo sapiens
ttccaggcctcaccccgtggattcttattttttttttttcttcatgcaggatatgcccttctgttagcatattcctttttcacatggaggatgaagaaggcaacagctttagctctgctgagcaaccatgctcccctgagactgatggctcccaaatcattgaacctggaagttcatctgcttatcgtttaggataggtttctctacagatggctaatttcatttcccacatgctgaatttctttctagctttctgctcagagggg

SEQ ID NO: 69213 - DNA, 4256 bp, Homo sapiens
cccggcacttgacaacgtcgcagtctgcaagaggctgagctgaggagtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattatggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaactgtttctgtt

SEQ ID NO: 69214 - DNA, 4089 bp, Homo sapiens
cccggcacttgacaacgtcgcagtctgcaagaggctgagctgaggagtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattatggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaactgtttctgtt

SEQ ID NO: 69215 - DNA, 2882 bp, Homo sapiens
  misc_feature (138)..(138): n is a, c, g, or t
agtctactgatttcaaatgccaatctcttccagaaatacctgcataaacatgcccagaaataatgttttaccatctatctgggtatctgttaacccagtaaagttgacagcacagaatccaggaccagctaaacaagnaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattatggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaactgtttctgtt

SEQ ID NO: 69216 - DNA, 3213 bp, Homo sapiens
cccggcacttgacaacgtcgcagtctgcaagaggctgagctgaggagtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaccagctaaacaagaaaaaaatgagcttcgagattcaacagaacaatttcaagaatattataggcaaagattacgctatcaacagcattta

SEQ ID NO: 69217 - DNA, 774 bp, Homo sapiens
gagaacagaagaaatctgagggttgactcctgggattcaccaagctttacgtcaagaagaaaagggaaactagcaaaagatgaagtggcactgaaatcagggagaaatcaagttgagagaatttccgagagagagagagaggcaacttgtcaaatgttgctgtatgggtatatgttagcaaatactaatagcataattaggtaggtagtaatttatccctgtataaacctttcaatgtattatattaatgtagtttaagattttttatactgtaatgtcttaaagtaacaggaagtctatacaatctatacatatacttattttgcattgtaaatcaacatctcttttgtaatttaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactcca

SEQ ID NO: 69218 - DNA, 4172 bp, Homo sapiens
cccggcacttgacaacgtcgcagtctgcaagaggctgagctgaggagtcgctgggccgggaggggcggacgtgagaaggacggattgacgaactgatggattgacgcgcgggcggtaggagggaggaccgacgccaaacccagaccgccgccgtcgtgctcctgccgcagcccggagccggccgcttcggggccctggccgccggcctcccagccgcgttctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattatggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaactgtttctgtt

SEQ ID NO: 69219 - DNA, 4153 bp, Homo sapiens
actctagaggagccactgacgctcctttagcttctcagcttcttcctccatctccctgactcgagctttgatagcttccagctccggggcctcaatggcgccgtcccccgtgtcaccctcctccgccgctcctccgggcttgccctggagccctcaggctatcaatatgacggctgaagaaacagtgaatgtaaaagaggttgaaatcattaagctaattttggacttcctgaattcaaagaagcttcacattagtatgctggccctggagaaggaaagtggagtcataaatggcctgttttcagatgatatgcttttcctgaggcagctaatacttgatggtcaatgggatgaagttcttcagttcattcagcctctagaatgtatggaaaaatttgacaaaaaaaggtttcgttatattatcctgaagcagaagtttttagaagctttatgtgttaacaacgcgatgtcagcagaagatgagccccagcatctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtacaaaacctcagtagaagtctcatgcttgagaatacagaatgtcacagtatttacgaagaatcccctgagcgtgatacacctgttgatgcacagaggcctatcggcagtgaaatcttgggccagagttcagtttcagaaaaagagcctgcaaatggagcacagaatccaggaccagctaaacaagaaaaaaatgagcttcgagattcaacagaacaatttcaagaatattataggcaaagattacgctatcaacagcatttagaacagaaggagcaacagcggcagatataccaacagatgttgcttgaaggaggcgtgaatcaggaggatggtcctgatcagcagcagaatcttactgaacagttccttaataggtccattcaaaagcttggtgaattaaatattggaatggatggccttggtaatgaggtatcagcactcaaccagcaatgtaatgggagcaaaggcaatggatctaatggttcttctgtgactagttttactacaccaccccaagactctagtcagagattaacacatgatgcttcaaatattcatacaagcactcctcgtaatcctggatcaacaaatcacataccttttctggaggaatcaccttgtggaagccaaatctcttcagaacattcggtcattaagccacctcttggagattctccagggagtctttcaaggtcgaaaggggaagaggatgacaaatcaaaaaagcagtttgtttgtattaatatcctagaagacacacaagctgttagagcagtggcttttcatccagctggaggtttatatgctgttggttcaaattcaaaaactctgagagtatgtgcctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattatggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaactgtttctgtt

SEQ ID NO: 69220 - DNA, 2113 bp, Homo sapiens
  misc_feature (16)..(16): n is a, c, g, or t
cctcgtgcaagtcgancctgtggcgctctatccagatgtaattgatccaagtgcacatgagactcctaagcagccggtggtacgttttaaaaggaataaacatcataaaggatccatttactgtgtggcctggagtccttgtgggcagttattagcaacaggatcaaatgacaaatacgtcaaagtgctgcccttcaatgcagagacttgtaacgcaacaggaccagatctggaatttagtatgcatgatggaacaattagagacttggcatttatggaaggcccagaaagcggaggagctattttaataagtgctggagcaggggattgtaacatttatacaaccgattgtcaaagaggacagggcctccatgctttgagtggacatactgggcatattttagcactttatacctggagtggctggatgattgcatctggttcccaagataagactgttagattttgggatcttcgagtaccaagttgtgttcgtgttgttggcacaacatttcatggaactggcagtgcagtggcatctgtagctgtagatcccagtggtcgtctcttagccacaggtcaagaagattctagctgcatgttgtatgacataagaggaggaagaatggtacaaagttatcatcctcattccagtgatgttcgctctgttcgattctcccctggagctcactacttgctaacaggctcttatgatatgaaaataaaggtgacagacctacaaggggacctcaccaagcagcttcctatcatggtggtgggggagcacaaggacaaagtgattcagtgcagatggcacacccaggatctttccttcctgtcatcctctgcagatagaactgtcaccctctggacttacaatgggtagagcacaccgcatgtcagtctatgcagcaaaagcacagagacttaagactactgagttgtgaaaattacaaatctgaagaacatagtgtccaggaaagtggtttagcacgaagaggccccttattaccatgtatcccactgataggaggtgttgggtggtgttattccgcagtgctttcagtcttccatgtgagctcgtgctgctgtgacctgctatatgtagtctcgttgccaaagtctgcagaagagctcttcagttgttggtgtgcactccaagtcaggatggacaatgtgtttacggtttagtattcaatgcattccttggtctttgcctaaataacagttttatatgcacattgaaatggaattatacttcaactatattattaaatgtaatgcaaccaagttcctcccagattaaacttcccaggtgttcagaattacttttgctcttctcacgatcccatattgtattatcacttgtcttctagaggtcagaattccataatatatgtcactcaaaagttacatggttgctttcacttaaggatcattatggagtttaaagatgaatgaaaaactgcttcttagtttactacatggtataggcccttttttcttaaacccagggatatgattattttgtcatataattttgtttcaggctaaaaggtaaatgtgtttgcttcagaaacttgttaacttcagttttttgaatgcaacaggatacctcccttccaaactgaactgtagaagcagagcagcagcagttatgtgatgcaacacttgatggtacagtaaatttactggcatttttctccttaaaaattaaaatccttgacatagaccatagcatggcttgaaatgctatgtctgcatgataatttaaaatggaagatttaaactttgcactccaaaagcttatttggatttttttcttgcactgttttgtgtaatgcagaataatgattttatttctacagctttgtagattctaacatttatgtatctttattttcatattgtacagtaattttactttaaattatttaaataggctattttatttatttcaaatgcagttgtattagttctcattattgaactgtctgtgcactgtatgtagcaagcatttttcatctgttgtatacaagtggaaagggtattagaagtgtaactgtgctattatttcaataaagacctcttgacatttaaaactgtttctgtt

SEQ ID NO: 69221 - DNA, 814 bp, Homo sapiens
ctcattaatctcatcagcattaaaactcctaggatataaaattaaaaccatccatcatagacgctcgtagattcctctgctgggaaatattttttctcaagatagaaatgggaattttcagttatgtgacttaaagacttgaaaacagttgaaacttgaattagactgttcaaataatctttttttatattaaaatatcttattatatggtagattattatttttcagttttgaaagttttgtgaacagatggccaagttttgttgcactgattttcaagggctgattgagggccattattaagaaaagaggcattacagttgcgtacagttcttgaatatcatcttagtgtactgctaaatcccattatgaagaattcattggcagtctgctgaaaggtacactagcttataccacacacagcggtacattcttaagcacgttgttatccagaagttaatgactatctttgtttacgaagttgtatatagggtgactaagagcagctgaaaagaaatgcaacccatgccaagtataattagctttttccttgaatactggaatcacccgtttaccctagttagaggcctttgatatttttggtggttgctttctagcacattagctatcagccactcttctagaattgcttaacatgatgggctttgcttgaaagcagactggtaacctatgaaaacatcacagtattgatgattttcaggactagggatcacaactgcagtttcatatggttggatggagtagtctttttgtggaggaatttatatgagaatcttagcttactgtctctttg

SEQ ID NO: 69222 - DNA, 440 bp, Homo sapiens
tctatgaaattactcgtatttatttagtttttctccttcaacaaaaatggaatcaactataaaaactcttgcatcctactttttttcacttactaaatcttagagagttttctgtcaaaacatattgccctagctcatttaaaaaaataacatatatcttatcagtttcctgtgaatagccatttagtctgtttcccatttttattaaaacaatcagtgcccatgtttacttttttttttttgagacggagcttcgctcttgttgcccaggctggagtgcaatggtgtgatctcagctcagcgcaacctccgcctcccaggttcaagcgattctcatgcctcagcctcctgagtagctgggattacaggcatgcaccaccatgcctggctaattttgtatttttagtagagacggggtttctccatgttggtcaggctgg

SEQ ID NO: 69223 - DNA, 383 bp, Homo sapiens
cgcgttcattatgtaccttggcaatgggcaaaaagccaaccattctgcagggcaagccaattgcctgcctcctacacacaagccttgatccgtcttgatgacaacttggttctcagctcttcttcctctctgctctcatccttactcagccagtctctactctcatcttctgtttcagtctagctgtcacagcctctatagcctccatttactactgctcagaaaggactccctttgtctcttcgtactcaagatgccccaacttgaacttaatgtctattttgctcatcaccacactcccagctggcccctgcttcctgttagcaaaactggaccaggtggctgaggttccaggggtcaggagaccctaacttctccaggct

SEQ ID NO: 69224 - DNA, 1214 bp, Homo sapiens
gggatttcttttcattatggggctcaatgtatttcttattactgattacacatccacctggtgtcatatccacctatttacatcttcagcctggcttgattgttaacatgtggggagtttgtgttttggtgccgtgtgagtgtgtgtctgaaagcagtgagttatgaatgtagtagggattccaggaatgatgtgtatgggtgtttgcatagcaaacgaagcaggaattttctgtgtataaaaataggaatgtgcacctaactgatgtactagataactgagtccagtgatcttcctttcccataaaaaattccaaatgagagcaagattattacaacagccttataacaaaaggaaagaaaaaaaaatcacagtcagcaaaatttacaaagaacggtcatttcagcattaaatatattgtgctgtttagactctcaatttaaattttttctctcaaatgagatttctaaactcattctacactgtcaagattgagctgctgcaggcaatgaggcatgcagtctccaggtgactgaagtttcagggacaaatgtgacttccaaaagagtcactgcaccatttgtctgcttgaccctgttcatgcccagaagctgcacagccaagaactcccaagacaggtgtttccaaagaagaaaaaaatttttttaatgtatgtgaagatatgtgtgtgcatctgtggagatagtggaatagaaaggaccccagtttcaataaatgaatgacctaatataggaaatcactaatttgatatagtcggcatctatacattaaaaaaaaaaacctttttcaggagttttgagagaaaaaatctttttcctaaattgaaggaggatttaatgcacttagaaactagagattcttcagggaaaccttataacctgctttttttttttttcttaacatggtgtccccatttaaatgaatccagaggctgacaagggtttcagctttacaaagctgagcagccccttgatgtttagtgaaacgaaacagatgatttatcagctttaaatctaggttagggtttgcctgcttcaaacttattgatgggagcatgttggatgtgtggttaggcagcatgcttttcatttccccgaatcctttgccatcaacattattgcttgctaaagaaaaggatgtggtggagaggtaatcttcctaacctatactcttttaattgagttatttcctat

SEQ ID NO: 69225 - DNA, 571 bp, Homo sapiens
ctactactactaattcgcggccctcgacgtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttattttta

SEQ ID NO: 69226 - DNA, 3186 bp, Homo sapiens
gcgggcggggctgggcgcaggcagtctcccgccgccgccgccgctgccggacgcgcagagcgaggggcggctggaccgacggctgccgggccgagcgcacagagtcgcggcgcagggggcgtccccggccgggacgcgggtcgcgtcgttgtcctccgcgagcgtccggattgcaggctgtctgtccccagaccccagagcacgtccggcaccaccatgactgggctgttgaagaggaaatttgaccagctggatgaggacaactcctcggtctcctcctcctcctcttcctctgggtgccagtctcgctcctgctccccaagctcttctgtctcccgtgcctgggactcagaggaggaaggcccctgggatcagatgcccctgcctgaccgtgacttctgcggccccagaagtttcacccccctgtctatcctgaagcgggctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttccacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagtgtggggaacctggacaacctcagctgcttccatccagctgacatctttggtactagtgaccctggtggcctggccagctggacccacagctattctggctgtagcttcacatcaggcatcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactagggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgcgggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttattttta

SEQ ID NO: 69227 - DNA, 3147 bp, Homo sapiens
gcgggcggggctgggcgcaggcagtctcccgccgccgccgccgctgccggacgcgcagagcgaggggcggctggaccgacggctgccgggccgagcgcacagagtcgcggcgcagggggcgtccccggccgggacgcgggtcgcgtcgttgtcctccgcgagcgtccggattgcaggctgtctgtccccagaccccagagcacgtccggcaccaccatgactgggctgttgaagaggaaatttgaccagctggatgaggacaactcctcggtctcctcctcctcctcttcctctgggtgccagtctcgctcctgctccccaagctcttctgtctcccgtgcctgggactcagaggaggaaggcccctgggatcagatgcccctgcctgaccgtgacttctgcggccccagaagtttcacccccctgtctatcctgaagcgggctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttccacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagtgtggggaacctggacaacctcagctgcttccatccagctgacatctttggtactagtgaccctggtggcctggccagctggacccacagctattctggctgtagcttcacatcaggcatcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactagggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgcgggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttattttta

SEQ ID NO: 69228 - DNA, 3611 bp, Homo sapiens
  misc_feature (3210)..(3210): n is a, c, g, or t
  misc_feature (3219)..(3219): n is a, c, g, or t
  misc_feature (3221)..(3222): n is a, c, g, or t
gcgggcggggctgggcgcaggcagtctcccgccgccgccgccgctgccggacgcgcagagcgaggggcggctggaccgacggctgccgggccgagcgcacagagtcgcggcgcagggggcgtccccggccgggacgcgggtcgcgtcgttgtcctccgcgagcgtccggattgcaggctgtctgtccccagaccccagagcacgtccggcaccaccatgactgggctgttgaagaggaaatttgaccagctggatgaggacaactcctcggtctcctcctcctcctcttcctctgggtgccagtctcgctcctgctccccaagctcttctgtctcccgtgcctgggactcagaggaggaaggcccctgggatcagatgcccctgcctgaccgtgacttctgcggccccagaagtttcacccccctgtctatcctgaagcgggctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttccacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagtgtggggaacctggacaacctcagctgcttccatccagctgacatctttggtactagtgaccctggtggcctggccagctggacccacagctattctggctgtagcttcacatcaggcatcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactagggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgcgggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttatttttaaaaaaaaaaaaaaaaaaaaaaaanaaaaaaaanannaaaaaaaaaaaaaaaaaacaaaaaaaaaaattgtgtgtgggcgcgcgccgcgcggcgccccccggaaaagtttttaaaacccccttggtgggggcgcgggggcgcccccaggagtaggagaagaacagtgcgggacaccagggggtttcctccaggagagaaacacccggcggcaaccagaacagagcgggcggggggtagctcccaccaaataaaaaaaaacccgcgccgcgggggaagaacgacacgtgggttctgaaaacaaacccccctacagaaggagggccctcgagaggagaccacagacgggaggctcctctaaaccaagagggggccaccaaggagagcgcccccagagtatcaaataattacccccccgccgggtgggt

SEQ ID NO: 69229 - DNA, 2967 bp, Homo sapiens
gcgggcggggctgggcgcaggcagtctcccgccgccgccgccgctgccggacgcgcagagcgaggggcggctggaccgacggctgccgggccgagcgcacagagtcgcggcgcagggggcgtccccggccgggacgcgggtcgcgtcgttgtcctccgcgagcgtccggattgcaggctgtctgtccccagaccccagagcacgtccggcaccaccatgactgggctgttgaagaggaaatttgaccagctggatgaggacaactcctcggtctcctcctcctcctcttcctctgggtgccagtctcgctcctgctccccaagctcttctgtctcccgtgcctgggactcagaggaggaaggcccctgggatcagatgcccctgcctgaccgtgacttctgcggccccagaagtttcacccccctgtctatcctgaagcgggctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttccacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagtgtggggaacctggacaacctcagctgcttccatccagctgacatctttggtactagtgaccctggtggcctggccagctggacccacagctattctggctgtagcttcacatcaggcatcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactagggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgcgggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggggccttgccagcctgtgtgcttgtgggaacaccttgtacctgagcttacaggtaccaataaagaggctttattttta

SEQ ID NO: 69230 - DNA, 2102 bp, Homo sapiens
gcgggcggggctgggcgcaggcagtctcccgccgccgccgccgctgccggacgcgcagagcgaggggcggctggaccgacggctgccgggccgagcgcacagagtcgcggcgcagggggcgtccccggccgggacgcgggtcgcgtcgttgtcctccgcgagcgtccggattgcaggctgtctgtccccagaccccagagcacgtccggcaccaccatgactgggctgttgaagaggaaatttgaccagctggatgaggacaactcctcggtctcctcctcctcctcttcctctgggtgccagtctcgctcctgctccccaagctcttctgtctcccgtgcctgggactcagaggaggaaggcccctgggatcagatgcccctgcctgaccgtgacttctgcggccccagaagtttcacccccctgtctatcctgaagcgggctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttccacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagtgtggggaacctggacaacctcagctgcttccatccagctgacatctttggtactagtgaccctggtggcctggccagctggacccacagctattctggctgtagcttcacatcaggcatcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctgccccttgcccaggaggccttgccagcctgtgtgcttgtgggaacaccttgtacctgagcttacaggtaccaataaagaggctttattttta

SEQ ID NO: 69231 - DNA, 724 bp, Homo sapiens
tggaggcccggcgtgcgtcagcgcagtgagccccggagttttccactgacgaggagggcggagcggcgggcggggctgggcgcaggcagtctcccgccgccgccgccgctgccggacgcgcagagcgaggggcggctggaccgacggctgccgggccgagcgcacagagtcgcggcgcagggggcgtccccggccgggacgcgggtcgcgtcgttgtcctccgcgagcgtccggattgcaggtgagcgccgaggggcctcgggcccggcaggacgggactttggggagggggcattcagcgcgagtggcactgccgctcctgcctcctgccgttcactccccggcaccctgagcgggcgcgggggctggagctgcccggctctgacggcgtgccgcggccggagtcgggggccgggggcccggccggcgggagtcgcaggttttctgctcccctcccccgcccgccgcggtaaccccgagagaagtcacggctccccgagctcggcgcgagtggggacagagccgggcttgcgcgcgagcggcgaggcgacgggggcgtgcgtccgcgggtgagtttccttttgacccagttgcctgagaacttttcagaagttcctcgcgtggccggagcaggtgacatttgtcgccttcctcctcgggctcccccctcggggaggctgcgggagctgcggcgtgtgccgggcgcccccggccggcgggggtc

SEQ ID NO: 69232 - DNA, 1982 bp, Homo sapiens
aggctggtcctggtcccgggggtgtatgggatcgccgccgctgccggacgcgcagagcgaggggcggctggaccgacggctgccgggccgagcgcacagagtcgcggcgcagggggcgtccccggccgggacgcgggtcgcgtcgttgtcctccgcgagcgtccggattgcaggctgtctgtccccagaccccagagcacgtccggcaccaccatgactgggctgttgaagaggaagaggaggaagggagtgtggggaacctggacaacctcagctgcttccatccagctgacatctttggtactagtgaccctggtggcctggccagctggacccacagctattctggctgtagcttcacatcaggcatcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactagggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgcgggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttattttta

SEQ ID NO: 69233 - DNA, 3575 bp, Homo sapiens
  misc_feature (3210)..(3210): n is a, c, g, or t
  misc_feature (3219)..(3219): n is a, c, g, or t
  misc_feature (3221)..(3222): n is a, c, g, or t
gcgggcggggctgggcgcaggcagtctcccgccgccgccgccgctgccggacgcgcagagcgaggggcggctggaccgacggctgccgggccgagcgcacagagtcgcggcgcagggggcgtccccggccgggacgcgggtcgcgtcgttgtcctccgcgagcgtccggattgcaggctgtctgtccccagaccccagagcacgtccggcaccaccatgactgggctgttgaagaggaaatttgaccagctggatgaggacaactcctcggtctcctcctcctcctcttcctctgggtgccagtctcgctcctgctccccaagctcttctgtctcccgtgcctgggactcagaggaggaaggcccctgggatcagatgcccctgcctgaccgtgacttctgcggccccagaagtttcacccccctgtctatcctgaagcgggctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttccacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagtgtggggaacctggacaacctcagctgcttccatccagctgacatctttggtactagtgaccctggtggcctggccagctggacccacagctattctggctgtagcttcacatcaggcatcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccacctggggatgccagcagttgcttcctggagtccctcatgggcttctccgagccagccgccgaagccctagatccctttattgacagccagtttgaggacactgtcccagcatctctaatggagcctgtgccggtgtgaggaccaggatgtcttttcccagccccaagagacctgttgctgctttcttgtaattatggggctccccagagtctgcgtaacagtctcccactggctggctcacccacaggtgccatgtgcacactcctggttttcaaacaattctctggatttatttatttgttttaacttttctgtgctgaagagaggactagggggagggggcttcccctttcagctgcccggccccccacacccacagcttgctcttctatctccacaacgtgagcctggaagaggagaaaatgtggctcctctggagcttggcagaccacttttcggtctttgcgtgatgttccttagcccaaagacggtgagacagggctgaaatcaggtggcttctgccaccctgagccctagacccatgggtggctaaatccactggactgtgaagactataatttatttccataatttatttggagattgaggaggctttggttgcacttctttggctggtgggtaatgccaggggtggggtgggcacaggccctcaagagccccttttgccttgtagtcctacaccttgccctgcctgggctttggtgcagactaggtgtggatttgagctctgtgatctatgtctgctgcctggctcctagatggctctgcgggcaggtgctggccaaggacatcatctaggcagggggagagcctgggctgaacagctgtgaccaaaactcccttctgccccaccctgccccctccacttcctgccctctgttccatcttcccccttcccaaaggccacagcctttattccaggcccagggatgtaggagggggaaggaggaaacaggaagcccagagagggcaaagggcctacctcggggcgcgaaccatgccccagactattatctcagggctttctgggcactgcacttcagcgtggcccacctgcccatgccctgaggccagttggcgaggggtggctcctgagggtttttataccctttgtttgctaatgtttaattttgcatcataatttctacattgtccctgagtgtcagaactataatttattccatttctctctgtgtctgtgccaagaaacgcaggctctgggcctgccccttgcccaggaggccttgccagcctgtgtgcttgtgggaacaccttgtacctgagcttacaggtaccaataaagaggctttatttttaaaaaaaaaaaaaaaaaaaaaaaanaaaaaaaanannaaaaaaaaaaaaaaaaaaaggggggggcgggccccaaggacccccccagggggggccacacgaaaaccgcctccccaggataaggggacacaggggggcaccaagacgccagccaggacagaccgcaggccccgcggacgagagcacaccagccgaaaggggcaacaagggcaacccgcggccacacgacgcaagggcaccccacccggcgggagcgcacacacggggaaccccccaacgacacaacacccccccggcacccacaccacccacgcggcccacgaggccccacccgcccccccaccgagcgcgccaccaccgcctccacggccccgcccagcacccacccccgc

SEQ ID NO: 69234 - DNA, 1938 bp, Homo sapiens
gcgggcggggctgggcgcaggcagtctcccgccgccgccgccgctgccggacgcgcagagcgaggggcggctggaccgacggctgccgggccgagcgcacagagtcgcggcgcagggggcgtccccggccgggacgcgggtcgcgtcgttgtcctccgcgagcgtccggattgcaggctgtctgtccccagaccccagagcacgtccggcaccaccatgactgggctgttgaagaggaaatttgaccagctggatgaggacaactcctcggtctcctcctcctcctcttcctctgggtgccagtctcgctcctgctccccaagctcttctgtctcccgtgcctgggactcagaggaggaaggcccctgggatcagatgcccctgcctgaccgtgacttctgcggccccagaagtttcacccccctgtctatcctgaagcgggctcgccgggagcgcccaggccgtgtagcctttgatgggatcaccgtcttctacttcccccgctgccagggcttcaccagtgtgcccagccgtggtggctgtactctgggtatggcccttcgccacagtgcttgccgtcgcttctctttggctgagtttgcgcaggagcaagcccgtgcacggcacgagaagctccgccagcgcttgaaagaggagaagttggagatgctgcagtggaagctttcggcagctggggtaccccaggcagaggcagggctgccacctgtggtggatgccattgatgacgcctctgtggaggaggacttggcagtcgctgtggcaggtggccggttggaagaagtgagcttcctacagccctacccagcccggcgacgtcgagctctgctgagggcttcaggtgtgcgaaggatcgatcgggaggagaagcgggagctgcaggcactgcgccaatcccgggaggattgtggctgtcactgcgataggatctgcgaccctgagacctgcagctgcagcctggcaggcatcaagtgccagatggaccacacagcattcccctgtggctgctgcagggagggctgtgagaaccccatgggccgtgtggaatttaatcaggcaagagttcagacccatttcatccacacactcacccgcctgcagttggaacaggaggctgagagctttagggagctggaggcccctgcccagggcagcccacccagccctggtgaggaggccctggtccctactttcccactggccaagccccccatgaacaatgagctgggagacaacagctgcagcagcgacatgactgattcttccacagcatcttcatcagcatcgggcactagtgaggctcctgactgccccacccacccaggcctgcctggccctggcttccagcctggcgttgatgatgacagcctggcacgcatcttgagtttcagtgactctgacttcggtggggaggaggaggaagaggaggaagggagtgtggggaacctggacaacctcagctgcttccatccagctgacatctttggtactagtgaccctggtggcctggccagctggacccacagctattctggctgtagcttcacatcaggcatcctggatgagaatgccaacctggatgccagctgcttcctaaatggtggccttgaagggtcaagggaaggcagccttcctggcacctcagtgccacccagcatggacgctggccggagtagctcagtggatctcagcttgtcttcttgtgactcctttgagttactccaggctctgccagattatagtctggggcctcactacacatcacagaaggtgtctgacagcctggacaacatcgaggcacctcacttccccctgcctggcctgtctccaccatttaggaagcagctggcatccaggttggcattctcatccaggacgcctgatgtgaagctacagccagaatagctgtgggtccagctg

SEQ ID NO: 69235 - DNA, 383 bp, Homo sapiens
caaaagccagaattgacaaatgggatctaattaaactaaggaacttgtgcagttttatttgggagtgtgcatgaggtacctctgagttttaaaaatgaagaaagtaagtggtcatgctttcctgactctttggtagacacagccttttaagacggtgattctgagctgttatggttttgggttttctataatactaaagcttactgccgacatgtaaccaaaagcttgaattaatgaaaaaaaaattacccaaatgcacgttaaaaacctcttacaacatatgtgcacattcatagataacatgtagaactttattttgtgttaaaaagcttgtagaaaagttcaggcagtgcacttaatgaataaaacttggtctttgtaaa

SEQ ID NO: 69236 - DNA, 359 bp, Homo sapiens
gcaatgtctgcctcccaggctcaagtgattctcgtgcttcagtctcccaagtagctgggacctataggtgtgcaccaccttgcccggttaatttttttagcagagacacggtttcaccacgtttcccagactggtcttgaactcctgagctcaagcgatctgcctgccttggcttccccaagtgctgggattacaggtgtcagccacctcacccagcctcattagattaattaataagaaaaataaagattttatgggttatcaaatgctttatattgctagtctttttaattttagtaagatagtcctgaaagtgatattgctgggtcagagggcctgtacattttatatcttgtaga

SEQ ID NO: 69237 - DNA, 318 bp, Homo sapiens
tacaaaaagaaaataaatatgatacaaactctaataggaaaatgcacagagagcacataagaggggatgagtttcaggaagacttcccaagggagaaaatactttagtggaatgttaaaggacaaatactcattacctcagcagaagatagagttaaaggaaattttatatatggcaatgatttttcaaaatttatggagctaaaatgcatgacatttccaagagccacatgtgctttggctggagtgcccaatatggtggagatgagtatgagaaatgatggacaagaagctggtgcaggtcacaaaagacctttgt

SEQ ID NO: 69238 - DNA, 734 bp, Homo sapiens
tttagggccttgatgtttcagcatggaatcctctgcacaggaagtatttcctctttactgagggccccactggcggtgacattttaaccttaatcttgccaatcttgtcactatcagatttcagtttctggtttgcattgagtaagagcttggatgaggaaatagactttttcttaaatgcattcgaatcataattttccctaatctttcttatgtgaagcagctctccactgcaagtatttgttttgtcatttaaaaaggatttagtgaaattcaagcctgggcaacatggcagaacccatctctggtaaaaatacaaaaattagccaggcgtagcatgtgtaccctctagttctagccacttgtgagactgaggtgaagggatcgcctgagtctgggaagttgaggctccagtgagccgtgtttgtgtcactgcacttcagcctgggtgacaaaatgagaccctgtctaaaaaaaaaaaaaaaaaaagatttaatgaaatttagacatttgtttgatggttgttcaatcatctgtttctcatatgttcatgcagcatcatatacacctaaatgatcatgttttgtttcaaattaaggcaacagaatgttttagggaaattgtcccaagcgcaggcatacttgttaatgatctagcagggacatcttatgcacatcaccttctctgaggccggataagagcgtgggataggtcagaacacagactcagaatgg

SEQ ID NO: 69239 - DNA, 596 bp, Homo sapiens
gagaaagggcctttaaaggtgactaagataaaacaaggtcatatggatgagctctaatccaataggactggtgtctttatcagaagaggacagacacacagactcagggacaatcacgtggggacacagcaaaaaggtaaccatttgggagccaaggaaagaggctctactaaaaatacaaaaattagccaggcgtagcatgtgtaccctctagttctagccacttgtgagactgaggtgaagggatcgcctgagtctgggaagttgaggctccagtgagccgtgtttgtgtcactgcacttcagcctgggtgacaaaatgagaccctgtctaaaaaaaaaaaaaaaaaaagatttaatgaaatttagacatttgtttgatggttgttcaatcatctgtttctcatatgttcatgcagcatcatatacacctaaatgatcatgttttgtttcaaattaaggcaacagaatgttttagggaaattgtcccaagcgcaggcatacttgttaatgatctagcagggacatcttatgcacatcaccttctctgaggccggataagagcgtgggataggtcagaacacagactcagaatgg

SEQ ID NO: 69240 - DNA, 1944 bp, Homo sapiens
acaggacccaggtgctgggggagaacagacctcgggagcagccaggagtcctcggtcctgggagggtttaaaagccagggggccgtctcgacctcagtctgaccttccctcccggcagcagcatgcgggggttgctggtgttgagtgtcctgttgggggctgtctttggcaaggaggactttgtggggcatcaggtgctccgaatctctgtagccgatgaggcccaggtacagaaggtgaaggagctggaggacctggagcacctgcagctggacttctggcggggccctgcccaccctggctcccccatcgacgtccgagtgcccttccccagcatccaggcggtcaagatctttctggagtcccacggcatcagctatgagaccatgatcgaggacgtgcagtcgctgctggacgaggagcaggagcagatgttcgccttccggtcccgggcgcgctccaccgacacttttaactacgccacctaccacaccctggaggagatctatgacttcctggacctgctggtggcggagaacccgcaccttgtcagcaagatccagattggcaacacctatgaagggcgtcccatttacgtgctgaagttcagcacggggggcagtaagcgtccagccatctggatcgacacgggcatccattcccgggagtgggtcacccaggccagtggggtctggtttgcaaagaagatcactcaagactacgggcaggatgcagctttcaccgccattctcgacaccttggacatcttcctggagatcgtcaccaaccctgatggctttgccttcacgcacagcacgaatcgcatgtggcgcaagactcggtcccacacagcaggctccctctgtattggcgtggaccccaacaggaactgggacgctggctttgggttgtccggagccagcagtaacccctgctcggagacttaccacggcaagtttgccaattccgaagtggaggtcaagtccattgtagactttgtgaaggaccatgggaacatcaaggccttcatctccatccacagctactcccagctcctcatgtatccctatggctacaaaacagaaccagtccctgaccaggatgagctggatcagctttccaaggctgctgtgacagccctggcctctctctacgggaccaagttcaactatggcagcatcatcaaggcaatttatcaagccagtggaagcactattgactggacctacagccagggcatcaagtactccttcaccttcgagctccgggacactgggcgctatggcttcctgctgccagcctcccagatcatccccacagccaaggagacgtggctggcgcttctgaccatcatggagcacaccctgaatcacccctactgagctgaccctttgacacccttcttgtcctcctctctggccccatccaggcaaccaaataaagtttgagtgtaccaggaacagaatcctggggcttgcaaaaaaaaaaaaaaaaaaaaaaaaaaaaagaaaacaaaaaaaaaaaaaaaaaaaaacaaaaaaagggggggcgccacacaaaaaataccccagggggggcccaaaatagggggccaccccagaatctactgtgacaaaagggacgcccaaaaagagggaggcaggacatacatcacagacccagacgacgcgacggcgtaaaaacaaggcacaaaactggagaacacgggaaacggagcgacactaggaagagaggcgccccccatacagatggagggcagggcacaacactcggcggcacccaccaccccaccgcgaggagactacacaccccacaggggggacaacaaacacagaagtacccaagcgtacaacacggggctaaaccacagagcacgaaatatgcgcccggccaccgcgagaaaccttcgccaccccgaacgtacacgcgagacgccttatcacc

SEQ ID NO: 69241 - DNA, 1715 bp, Homo sapiens
  misc_feature (1508)..(1508): n is a, c, g, or t
  misc_feature (1517)..(1517): n is a, c, g, or t
  misc_feature (1526)..(1526): n is a, c, g, or t
  misc_feature (1531)..(1531): n is a, c, g, or t
  misc_feature (1534)..(1534): n is a, c, g, or t
  misc_feature (1537)..(1538): n is a, c, g, or t
  misc_feature (1542)..(1543): n is a, c, g, or t
  misc_feature (1546)..(1546): n is a, c, g, or t
  misc_feature (1562)..(1562): n is a, c, g, or t
acaggacccaggtgctgggggagaacagacctcgggagcagccaggagtcctcggtcctgggagggtttaaaagccagggggccgtctcgacctcagtctgaccttccctcccggcagcagcatgcgggggttgctggtgttgagtgtcctgttgggggctgtctttggcaaggaggactttgtggggcatcaggtgctccgaatctctgtagccgatgaggcccaggtacagaaggtgaaggagctggaggacctggagcacctgcagctggacttctggcggggccctgcccaccctggctcccccatcgacgtccgagtgcccttccccagcatccaggcggtcaagatctttctggagtcccacggcatcagctatgagaccatgatcgaggacgtgcagtcgctgctggacgaggagcaggagcagatgttcgccttccggtcccgggcgcgctccaccgacacttttaactacgccacctaccacaccctggaggagatctatgacttcctggacctgctggtggcggagaacccgcaccttgtcagcaagatccagattggcaacacctatgaagggcgtcccatttacgtgctgaagttcagcacggggggcagtaagcgtccagccatctggatcgacacgggcatccattcccgggagtgggtcacccaggccagtggggtctggtttgcaaagaagatcactcaagactacgggcaggatgcagctttcaccgccattctcgacaccttggacatcttcctggagatcgtcaccaaccctgatggctttgccttcacgcacagcacgaatcgcatgtggcgcaagactcggtcccacacagcaggctccctctgtattggcgtggaccccaacaggaactgggacgctggctttgggttgtccggagccagcagtaacccctgctcggagacttaccacggcaagtttgccaattccgaagtggaggtcaagtccattgtagactttgtgaaggaccatgggaacatcaaggccttcatctccatccacagctactcccagctcctcatgtatccctatggctacaaaacagaaccagtccctgaccaggatgagctggatcagctttccaaggctgctgtgacagccctggcctctctctacgggaccaagttcaactatggcagcatcatcaaggcaatttatcaagccagtggaagcactattgactggacctacagccagggcatcaagtactccttcaccttcgagctccgggacactgggcgctatggcttcctgctgccagcctcccagatcatccccacagccaaggagacgtggctggcgcttctgaccatcatggagcacaccctgaatcacccctactgagctgaccctttgacacccttcttgtcctcctctctggccccatccaggcaaccaaataaagtttgagtgtaccaaaaaaaaaaaaaaaaaaaaaaaaaaaaactgtgtgttggggcgcgcgcccgnggcccccgngaaaaaggnttttnaanacnnattnncgnttggggcgcggcgggncccccagtggtatgtggcgacacttgggcgcatccgagcgggttccaccaaggagaacacctcggggccacgcgactttgggttgggtttctccccaacattaaaaaaacgcgccgggggggacccgggctgtctctggaaaaacccaagagg

SEQ ID NO: 69242 - DNA, 377 bp, Homo sapiens
ccactcagcattgcacaaggcacagagctttggacagggttggatcgttaacccaacccgtgtaaatattcccaaagtgattgaccctttctctcctattttactcctgccccagatcaagccagtggaagcactattgactggacctacagccagggcatcaagtactccttcaccttcgagctccgggacactgggcgctatggcttcctgctgccagcctcccagatcatccccacagccaaggagacgtggctggcgcttctgaccatcatggagcacaccctgaatcacccctactgagctgaccctttgacacccttcttgtcctcctctctggccccatccaggcaaccaaataaagtttgagtgtacca

SEQ ID NO: 69243 - DNA, 1688 bp, Homo sapiens
acaggacccaggtgctgggggagaacagacctcgggagcagccaggagtcctcggtcctgggagggtttaaaagccagggggccgtctcgacctcagtctgaccttccctcccggcagcagcatgcgggggttgctggtgttgagtgtcctgttgggggctgtctttggcaaggaggactttgtggggcatcaggtgctccgaatctctgtagccgatgaggcccaggtacagaaggtgaaggagctggaggacctggagcacctgcagctggacttctggcggggccctgcccaccctggctcccccatcgacgtccgagtgcccttccccagcatccaggcggtcaagatctttctggagtcccacggcatcagctatgagaccatgatcgaggacgtgcagtcgctgctggacgaggagcaggagcagatgttcgccttccggtcccgggcgcgctccaccgacacttttaactacgccacctaccacaccctggaggagatctatgacttcctggacctgctggtggcggagaacccgcaccttgtcagcaagatccagattggcaacacctatgaagggcgtcccatttacgtgctgaagttcagcacggggggcagtaagcgtccagccatctggatcgacacgggcatccattcccgggagtgggtcacccaggccagtggggtctggtttgcaaagaagatcactcaagactacgggcaggatgcagctttcaccgccattctcgacaccttggacatcttcctggagatcgtcaccaaccctgatggctttgccttcacgcacagcacgaatcgcatgtggcgcaagactcggtcccacacagcaggctccctctgtattggcgtggaccccaacaggaactgggacgctggctttgggttgtccggagccagcagtaacccctgctcggagacttaccacggcaagtttgccaattccgaagtggaggtcaagtccattgtagactttgtgaaggaccatgggaacatcaaggccttcatctccatccacagctactcccagctcctcatgtatccctatggctacaaaacagaaccagtccctgaccaggatgagctggatcagctttccaaggctgctgtgacagccctggcctctctctacgggaccaagttcaactatggcagcatcatcaaggcaatttatcaagccagtggaagcactattgactggacctacagccagggcatcaagtactccttcaccttcgagctccgggacactgggcgctatggcttcctgctgccagcctcccagatcatccccacagccaaggagacgtggctggcgcttctgaccatcatggagcacaccctgaatcacccctactgagctgaccctttgacacccttcttgtcctcctctctggccccatccaggcaaccaaataaagtttgagtgtaccaggaacagaatcctggggcttgcaaaaaaaaaaaaaaaaaaaaaaaaaaaaatttgggggcggccgggccccggaaaaagttttaaacctccttttggggccgcccgcccccttggttttggactggccacgcggcccacgaagccgggtctgcacggggtgggtctccccaaaaacgcccgggggcccgcgcttggcacacccggggccgcggctcggttcacgggccggct

SEQ ID NO: 69244 - DNA, 985 bp, Homo sapiens
gaagatgtccaaggtgtcgagaatggcggtgaaagctgcatcctgcccgtagtcttgagtgatcttcctggagatcgtcaccaaccctgatggctttgccttcacgcacagcacgaatcgcatgtggcgcaagactcggtcccacacagcaggctccctctgtattggcgtggaccccaacaggaactgggacgctggctttgggttgtccggagccagcagtaacccctgctcggagacttaccacggcaagtttgccaattccgaagtggaggtcaagtccattgtagactttgtgaaggaccatgggaacatcaaggccttcatctccatccacagctactcccagctcctcatgtatccctatggctacaaaacagaaccagtccctgaccaggatgagctggatcagctttccaaggctgctgtgacagccctggcctctctctacgggaccaagttcaactatggcagcatcatcaaggcaatttatcaagccagtggaagcactattgactggacctacagccagggcatcaagtactccttcaccttcgagctccgggacactgggcgctatggcttcctgctgccagcctcccagatcatccccacagccaaggagacgtggctggcgcttctgaccatcatggagcacaccctgaatcacccctactgagctgaccctttgacacccttcttgtcctcctctctggccccatccaggcaaccaaataaagtttgagtgtaccaggaacagaatcctggggcttgcaaaaaaaaaaaaaaaaaaaaaaaaaaaaatttgggggcggccgggccccggaaaaagttttaaacctccttttggggccgcccgcccccttggttttggactggccacgcggcccacgaagccgggtctgcacggggtgggtctccccaaaaacgcccgggggcccgcgcttggcacacccggggccgcggctcggttcacgggccggct

SEQ ID NO: 69245 - DNA, 325 bp, Homo sapiens
ggtactattacctttggatcactattattaatcattccttaatagaactttggatttttccccaggcttaagtacactggttatttctaattctttgtgattttcctggcttcagatctttccaggaacagctctgggtctcttggccaatttggcatcagggctctgggcctttgcccccagcttctgtgattctctcaaaggtctttcagtattgatcagggagtcattcccactgagtccttcaagttttcttttactgcttccccacaaaccgtagaatgagaaaaggatgattgaagtgaagagcctagcctagtgccgg

SEQ ID NO: 69246 - DNA, 762 bp, Homo sapiens
catgactttggatttcctcaggaggagtttgatggcaaccagttccagaaggctcaagccatctctgtcctccatgagatgatccagcagaccttcaatctcttcagcacaaaggactcatctgctacttgggatgagacacttctagacaaattctacactgaactttaccagcagctgaatgacctggaagcctgtatgatgcaggaggttggagtggaagacactcctctgatgaatgtggactctatcctgactgtgagaaaatactttcaaagaatcaccctctatctgacagagaagaaatacagcccttgtgcatgggaggttgtcagagcagaaatcatgagatccttctctttatcagcaaacttgcaagaaagattaaggaggaaggaatgaaaactggttcaacatcgaaatgattctcattgactagtacaccatttcacacttcttgagttctgccgtttcaaatattaatttctgctatatccatgacttgagttgaatcaaaattttcaaacgtttcacacgtgttaagcaacacttctttagctccacagggacaaaatctttacagatgatcatgccaatctatctattctatctatttatctatctgtctgtcttctatctaatctatttaaatatttatttatttataagatttaaattattttaaattatgtttgttcaggtaatattacatccaccttactttgtggctaatataataaaatatgttctttatgttttgtc

SEQ ID NO: 69247 - DNA, 216 bp, Homo sapiens
cttcattgggcagttgtagcttgttgtaactcatgaggtcagatgttggacagattctatctctgcctgaaggagttctcattttaggggaagtgatgagcaatcaagttattctgcaattataaaacagttggatactttccagaaaaggggtaaaagcaaggtgctgtggaaaacctaatccagtcttgagagtcagggaaaattttccagagg

SEQ ID NO: 69248 - DNA, 452 bp, Homo sapiens
gaatttgttggtacataaatattcgtccgtgttctgggatatttaagagacttccaaaagtataggacaaagaatatgaacactaccaaagctcattacttatattggctccactgctttaaaaaagatttatgacagcctttggtctcaccgtgatttcattgcaccctctctagcactgggtgttcactcttgttaaaaccctaaaaccagaaacaccttaattttaagaaaattttctattagagtaacatacatagaaaactgcacagatcattaatgtgatagcttgatacatttccacaaaataagcacacctgtgtaacaagacccaagttactagacaggacatttccagcctctcagaggtccccatcctgtcccctttcagtgactaaccatctcccctttctctccagaaaccaccatcctgacttgtaataggaaaaaaa

SEQ ID NO: 69249 - DNA, 436 bp, Homo sapiens
cacaatctcagctcaggccttattcatcaccgcattcctggcaccaggcctggcccatgagaaatgggtcagattaagagctaaatgtgttttcatggtcacttgttttcttcaggcctcctttctttgtgccaatatctttgggtttctggttaaagttttcagcagctgcatgcggttccatttttcttaccaggtaagagacatagcttcatgaaaacaaaggcagaacgcttgtgaccagagaactcccagtcctctccctgcataggaaaactggacttctccggaaggctccagctcctgggcaaatctctagggccacttaattgggctatcccccacctttgtttctggttttgaagggaccaaagttgggaatcctttttcagtctctacacacggagcccttctttggtgggaaagtcttaacata

SEQ ID NO: 69250 - DNA, 474 bp, Homo sapiens
ttgcagcgttatgatctgacaaataagacgtacagaagccagaaaggctccctagcttgctggttttgtgattacgaagattcttaactttatgaacagtaacagaaagtgacttctcactatctatttatcaagtggctggttcctacttatatcattcaaattattcactatcagttcaaatgtattttgaaatattgtcatttgtcactgccttataacatcccttgcatggttttcaacaaccttatcttcttcattgaatattttaaaacttttcttatgcaagcttcttttcctactaaattttgataccccagaaagcattggcgaacactagaagagacctgtttgcaaccagactgaggagctcaattgtttttactttgaactcagtaattgttgcttattatttatttaaataaattggctatatacttattcagaaaatatcaaaggaagctagaaagaaga

SEQ ID NO: 69251 - DNA, 3796 bp, Homo sapiens
cccctggcttttctggggaggcaggcagggttgtggccacagggatggaggggctcacaggcctctgccggatgctgctagtcctcctttaatctcagtatgggtggctggacccttggccgagtctcagtgtgggtgggcctcctgggcagctggcaggagggtgcagggggggtggggagccgtgcgaagaccccaaagggctaccacttggcggaagctctctctactcacaaccttagggttgcagtcaggggtcaccagggcctggctcagcctgggcagtggctggtcactgcggcctgggaaagaggtcctcggggtcctctgcagtagccctcacacgtggggaaggatttgcagttccctgggggccctgcttggtcctctgccacccccgagagcccagagtcactggagctgctctaaacatagtggcaggcagtgtccggcatgacctcatcgcctccacgtcccccacaacacccaccagcagccgccttgcctggcgccagccagtgacccaccctcttggctgggctgtggactcaggtgtccggctgtcatgtcctgtgagtcggggctgggcggggagcctcctgaggtgctcctctccctctgcgtggcagggaggaggctggcagccctggcccagtgtccagatgggacaaagtgggggtagggaccacagccagggtggcgtgatctggagccgcagggctggggggacttgccagggctgtagaggggatggtgtgggtgtggccagctgtgctgagggaggggcatccgatgtgtgtctgtgcatctgtgtgtggcctgtgtctgtctgtctgcctgggtgtggggtgagggggactctagtgctggaggctgcccagggccttgagagccaggcaagctggacgttcccaggaagagatgaggacccataataggtccaggaccaggggtcctgctccgtgaagtttggagggtccccaaggcttctctggccactgagcttgggccccagcattctccaaaagagggcaggcagttcatgagtctaggggcattcctctgcctctggaaccccacctcagtctgtcctggactaggtgggctatggcccacccttgggaaggagcctatctgtagcccccaagccccagtcagaaaggcagagtttgggggcaagctttctctacaagggtggggctggcctgggcactgagtggacactgtcctcctgcctgccacctgcccctctccctcagcttggacaggaaccccggcctctgagtgaggtccgcaaaggatgctgggtagtccccctccgtggctctgggtgggagcttggcttggcgcggctctgggccgggatggcaggacctcccagccactgcctgggcacagacctcccaggatcccaccagcccagcccctgcggctgcaagagcagcgaggctgggaccaattaccgagtcccgcagggcctggaccctcctgctcctcaagggtgaaggtgggggttcctgttggatgcagtttcaggtggagggggctctctggcctcccgaacctcggctctctccagttcagatcctaccttctgcccacagctgaacacctcttcctacagggagcccccgacctcccagccactgtcctccagaggccatagcatcttggtctccttctgtctgctgcctcggtaggcttcctttgggacccgtggaggcatgtctgactcctcaggagctctgtatttagtgggccttgtcctggggtggcggctccaggcctagtgagacatggcagaggccagggcagggagaatgtgaagctggggcgagggtctgtgacgaggccgcctgacgcctcagcaccaggtggacacagttgtgtgcatgtccctcttggccaatgacaggtccggttcaggtggcccttgcccagggacagaggcttctcctggctccgtgccttccagctctcagtcctggtgtgcacagcgtcaccgggcttccgatagctgccggcctcaactctgggagagggcaggtggggcggcaggaggtgcctgtgctttcctaggcatgagcaggcatgagaggtgcacatgctcctgctcacctgggcggcgcctctcaactgttaggtgtggggttagggttcacctgacgatttgccgcagtccagcggacccgagagttgcatgcagagctggggttgcggtgcgagtggggaagggtctgaaggtgtgggtgcagggggctgtgctggggcctgcaggctggggtgtgcggtgtgagtggggtgcttttgtagtctaaggggtgatgtgccagtcgtcgtgtggtgtcaggtgtcagtcgtcgtgtggtgtcagggtctcttctactcggtgctaagggccagcaggaccgagaggggtaggggcttctctgggtcgagggccacagggggctggtgggggtgggagtgctgaatgcacagggtgatgctgggcttcgggtagcagatgtgctgtggacagtcggggtcgggtcatctgcggcgagcggggcttctgtaggtgctcccagggccctggtgatgtggaagctgttctcaaattctggggtgttgtgctgtggtgggcatgtacctagggtgttatcaagggctgtgcccacttttaggggcactgggcaagagtcggggtgtcagagcagctgcttgagctccgtgggggccattgtgtggcccttggggtgtcctgccctgggggcggctgcagggccgcttgtgtccctgggtgttgctgcctgctgtgcggccttcccagtgatgtttgtgtgtgtgtgtgtgttgggggggttccatgggaagcaggctggggggctgggctgctccgggtttctgaggcaacagcagggaggggccaggaaactgcagctcaggaaggaaggccggccttgcaggagggggcctggggccagcttgggctgagcaggcgccagacattctgtgctgcggccccggcccccactggctgggagctcctgcccaagttccgctggccccacccttgtctccacctccatgcttgtatggctgcctttattcagaccgtggtgacttgggcttgggtctgtgggtgacctggtcctgtgcttatgtgagccccagtccatttgtggctctgtagaggcccagatggggctctcagtgtaccctgcaccgtggggcatgtgttagcacactccggtccccagggtccctggagggcagtgtccactctgactaccctgtcctgggctggcccagcctccttctcccctgccaggctggtaagtcgggagagggagaacatcctcaggggtcatctgtctcccagccacggaggggcactgcagggccggatgcctgaagctgtgtgtttctttttgttgcttgtcctggcattggtgacagccagctggggctgccacataggctggagggggcaggcctgtgttctgggggctcatccaccccttcttgctcagggacaggcaacatctatccatccatttgttattgagcacctgttgtgtagtagaccctgttttaggggttaggaatttggcagagaacaaaacagacaggtccctgcctgtgggaagcttccattatggtgagaagagacagacaatcaacaaatccacaaacaggtgtggtgactcatgcctgtaatcccagcactttgggaggctaaggtgggcggatcacctgaggtcaggagttcgagaccagcttggccaatatagtgaaacccctgcctctactt

SEQ ID NO: 69252 - DNA, 293 bp, Homo sapiens
cctccagaatgggtttcctgctttgcttgagaaatgctttaattgggtgtcattagtaatcctgtcaagggtaaaaaaaacctcccttgttaggaatcaaagcaaaaagctctctctgaggagtaatgaggaatatactctttctaatatgatgcggaagcacttaatatttgttattggtgtttacagaaatgattacttctcaaacattgctgcttacagaaatgattaattctcaaactatgccgggaaggtgagtatggtaatgattttacaagggaggaatctgaagt

SEQ ID NO: 69253 - DNA, 478 bp, Homo sapiens
ggggtcaggtaattatctttctctagtgcctattattttacaaatatctcattaaagacagccgatgataaccattctcatgattctttggcctcaaatgtgtttcactggtttgttttttatagtaggaaggaattatgttaatgttatgattcttagaaaagtattttgatcttattagtttagtgtgtatcctgattatgttttggaaataagtggttaaattgatctgtgggagtcttacaaactgattaccaagtttctgatacagcttgcctgtgtcttgatccacgtattgtaagtctttcctattatcagtgaatttttccatacttctgtttcagagaatggaatgatgactaagttaaaaatcacttcgggacaaaatttattatccttcacagggtaaatgacaaacatgtcatttacctggtagaggataccaatagtatctgtgttcacagtcagctatgctatg

SEQ ID NO: 69254 - DNA, 625 bp, Homo sapiens
ggtccacagcctcggtgtggaaaatggtctctgtggttgaattgagagaagagcaaatgaactggtctggaatagggtgtacacgtaagtagaagataagattgaaaacaaatttagtgccaaaatctgagggaccttgagccccatgccaaagagtctgtataccttatctaatttgtttaatggggccactaggcaattacgggtccgggacccgcatggcaagaatgccttccatccacagcagcccttgatgtgaggtcagaaagctaactgctaaacttgcagtcctgagggaacaccctcaaatggataaacccagctaagcaagctggaccatttccttgggaattattcacctctcaatcaaagaaggaaacttcccaaattcaatccatttgccttaacgtggtgtcccattaccatgaatactgagttgtatacattcttccctagctcccttgaacaaattagataaggtatacagactctttggcatggggctcaaggtccctcagattttggcactaaatttgttttcaatcttatcttctacttacgtgtacaccctattccagaccagttcatttgctcttctctcaattcaaccacagagaccattttc

SEQ ID NO: 69255 - DNA, 272 bp, Homo sapiens
ggtccacagcctcggtgtggaaaatggtctctgtggttgaattgagagaagagcaaatgaactggtctggaatagggtgtacacgtaagtagaagataagattgaaaacaaatttagtgccaaaatctgagggaccttgagccccatgccaaagagtctgtataccttatctaatttgttcaagggagctagggaaaaatgtatacaactcagtattcatggtaatgggacaccacgttaaggcaaatggattgaatttgggaagtttcctt

SEQ ID NO: 69256 - DNA, 2654 bp, Homo sapiens
  misc_feature (2540)..(2540): n is a, c, g, or t
ataggtcaggtagcgaggccggtgtctgatgaagtccaccagccgggatggccgtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggagatggccaattgtcaggctgtgatcctctccgtagaggatgacacagggcaccggatcatcatcgaggatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctganccctgtcagatgaaaatgattcacagctctggcagttcccaagtctggggaggggtataggtttgaaaggctgtttgaaagaggaatgtttaataaaggctttgatttaatctt

SEQ ID NO: 69257 - DNA, 7819 bp, Homo sapiens
  misc_feature (7705)..(7705): n is a, c, g, or t
ggatctgatactgcccaccatacagaagtccttactgaggagtccagagaatgttattgaaactatttctagtctgctggcatcagtgacgcttgacctcagccagtatgccatggacatcgtgaaaggactggctggtcacctgaaatccaacagtccccgcctgatggatgaagctgtgctggcactgcggaacctggcacgccagtgcagtgactcttcggccatggaatccctgaccaagcacctatttgctatcctcggaggctcggaaggaaaactaactgttgtagcccagaagatgagcgtcctctcagggattgggagcgtcagtcatcacgtggtgtctggaccttccagtcaggtcctgaatgggatcgtggctgagctgttcatcccgttccttcagcaggaagttcatgaagggaccttggtacacgctgtctcagtcctggctctctggtgtaaccgattcactatggaagtgcccaagaagctcactgaatggttcaaaaaagctttcagccttaaaacctccacatctgcggtgaggcatgcctacctgcagtgcatgttggcctcttaccggggtgacacgctgttgcaggccctggacttactgcccttgctcatccagacagtggagaaggcagcctcccaaagcactcaggttcccaccatcaccgaaggggttgccgcagccttgttgctcttaaagttgtcagtggctgactcacaggctgaggccaaactgagcagtttctggcagttgattgtggatgagaaaaagcaggttttcacttctgagaaattcctggtcatggcttcagaggatgccctgtgtactgtgttgcatctgacagagagacttttccttgaccacccgcatagactcactggcaacaaagttcagcagtaccaccgggctctggtggcggtgctcctgagccgcacctggcacgtccgcaggcaggctcagcagacagttcggaagctgctgtcctctcttgggggctttaagctggcgcacggactcttggaggagctgaagactgtcctcagttctcacaaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttagttgccgtgcagtctggactttggccagcacttcttgccaggatgaagatcgatcctgaagcctttatcaccaggcacctggatcagatcattcccaggatgaccacacagagtcccctaaaccagtcctccatgaatgccatgggctccctttccgtcctgtcgccggaccgggtcctcccacagctcatcagcaccatcactgcctccgtgcagaaccctgcactgcgcctggtgacgcgggaggagtttgccattatgcagacccctgctggggagctgtatgacaaatccatcattcagagtgcccagcaggacagcataaaaaaggccaacatgaagcgagagaacaaagcttattccttcaaagagcagatcatcgagctggagctgaaggaggagataaagaagaagaaaggcatcaaagaggaggtgcagctgaccagcaagcagaaggagatgctgcaggcccagctagacagggaggcgcaggtccggaggcggctgcaggagctggatggggagctggaggcggcgcttggactgctggacatcatcctggccaagaacccgtccggcctgacccagtacatccctgttttggtcgactcttttctgcccttgctgaagtctcccctggctgctcccaggatcaagaaccccttcttgtccttggctgcctgtgtcatgccctctaggctcaaggctttgggcactttggtgagccacgtgaccctgcgcctgctgaagccagagtgtgtcctggataagtcctggtgccaggaagagctgtcggtggctgtgaagagggcggtgatgctgctgcacacccacaccatcaccagcagggtgggcaagggggagccaggtgctgcgcccttgtccgcgccagccttctccttagtcttcccgtttctgaagatggtgctgacggagatgccccaccacagtgaggaggaggaggagtggatggcccagattcttcagatcctcactgtccaagcccagctgagggcctcccccaacaccccacccgggcgggtggacgagaatggcccggagttgctgcctcgcgtggccatgctgcgtcttctgacttgggtgatcgggacgggctcgcctcgcttacaggttctggcttcagacaccctgaccaccctgtgtgccagcagcagtggtgatgatggctgtgcctttgcagagcaggaggaggtggacgtgctgctctgtgccttgcagtccccgtgtgccagcgtgcgggaaaccgtgctccgggggctgatggaactccacatggtattgccagcacctgatactgatgagaagaatggcctgaaccttctgcggagactctgggtggtcaagtttgacaaggaggaggagatccggaagctggctgagaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctaccggccgcccccagtgctggatgctttgggacgagttatttcagaatctcctccagatcagtgggaagccaggtgtggcttggcgttggccctcaacaagctctcccagtatttggacagctctcaggtgaagccactctttcagttttttgtccctgatgccctcaatgaccgacacccagatgtccggaagtgcatgttggatgcagccctcgcaacgctcaacactcatgggaaggagaacgtcaactcgctgttgccagtattcgaggagttcctgaagaacgcgcccaatgatgccagctatgatgctgtgcgacagagtgtggtggtcctgatgggctctctggccaagcacctggacaagagtgaccccaaagtgaagcccattgttgccaagctcatcgctgccctctccaccccctcccagcaggtccaggagtccgtagccagctgcttgccacccctcgtgccagccatcaaggaggatgctggagggatgatccagaggcttatgcagcagctgctggagtcagacaagtacgcagagcgcaaaggggccgcctatggcctggcgggcctggtgaagggcctgggcatcctctcgctgaagcaacaggagatgatggcggcactgactgatgccatccaagataagaagaacttccgccggcgagagggagccctctttgccttcgagatgctctgcaccatgctggggaaactttttgagccgtatgtggttcacgtgctgccccatctgctcctgtgctttggggatggaaaccagtatgtgcgtgaggctgcagatgactgtgccaaggctgtgatgagcaacttgagtgctcacggggtgaagctggtgctcccctccttactggctgccctggaggaggaatcgtggcggaccaaagctgggtcagtggagcttcttggggcaatggcgtactgtgctcctaagcagctgtcatcctgtctacccaacattgtgcccaagcttacggaggtgctgaccgactcccatgtcaaagtccagaaggctggacagcaggcgctcaggcagatcggctccgttatcaggaacccggagatcctggccattgctccagtcctcctggatgccctgacggatccctccaggaagacccagaagtgcttgcagaccctgctggacaccaagtttgtccacttcattgatgccccatccctggccctcatcatgcccattgtccagagagccttccaggaccgttccacggacacgcggaagatggcagcccagattattggcaacatgtactccctgacagaccagaaggacttggctccgtacctgcccagcgtgacgcctggcctgaaagcatcgcttttggaccctgtgcctgaggtgcggaccgtatctgcaaaggcccttggggccatggtgaagggcatgggggagtcgtgctttgaggacttgctgccgtggctgatggagacactgacctatgagcagagctctgtggatcgctcaggcgctgcacaggggttggctgaggtcatggccggtttgggggtggagaagttggagaagttgatgccagaaatcgtggctacagccagcaaagtggacattgcaccccatgtccgagatggctacattatgatgtttaactacctgcccatcacctttggagacaagtttactccttatgtggggcccatcatcccctgtatcctcaaagctcttgctgatgagaatgagtttgtgcgtgacaccgccctgcgcgcgggccagcgggttatctccatgtacgctgagacagccatcgccctgctgctgccccagctagagcaaggcctctttgatgacctttggagaatcaggttcagctctgttcagctccttggggatctcctgtttcacatctcaggagtcactgggaagatgaccacagaaactgcctctgaggatgataactttggaactgcccagtccaacaaggcgatcatcactgccctgggggtagagcggcggaaccgggtgttggcagggctgtacatgggccgctcagacacccagctggtggtgcggcaggcgtccctgcatgtctggaagattgttgtctccaataccccccgcaccttgcgtgagatcctacccactctctttgggctcctgctgggtttcctggccagcacgtgtgcagataagagaacgattgcagcgagaacattgggagatcttgtgcggaagttaggggagaaaatcctccccgagatcatccccatccttgaggaaggcctgaggtctcagaagagcgatgagaggcagggtgtgtgcattggcctaagtgagatcatgaagtccaccagccgggatgccgtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggagatggccaattgtcaggctgtgatcctctccgtagaggatgacacagggcaccggatcatcatcgaggatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagccttaggcttggtaatccgcctgacctcggctgacgccctgaggccctccgtggtcagcatcactggccctctgatccgcatcctgggggacaggttcagctggaatgtgaaggcggctctgctcgagacactcagcctcttgttggctaaggttgggattgccctgaagcccttcctgccccagctgcagaccactttcaccaaagccctgcaggactccaaccggggggtgcgcctgaaggccgcagatgctctggggaagctcatttccatccacattaaggtggaccccctcttcacagagctgctcaatggcatccgcgccatggaggacccaggtgtcagggacaccatgctgcaggccctgaggtttgtgattcagggagcaggggccaaagtggatgccgtcatccggaaaaacatcgtctcactcctgctgagcatgctgggacacgatgaggacaacactcgcatctcctcagccgggtgcctaggggaactgtgtgcctttttgactgaagaggagcttagtgccgttctacagcagtgcttgctggcggacgtgtccggcattgactggatggttcggcacgggcggagcctggcactttccgtggctgtgaatgtggctcctggcagactttgtgccggcagatatagcagtgatgttcaggaaatgatcctgagcagtgccacggcggacaggatccccattgcggtgagcggggtccggggcatgggctttctcatgagacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctganccctgtcagatgaaaatgattcacagctctggcagttcccaagtctggggaggggtataggtttgaaaggctgtttgaaagaggaatgtttaataaaggctttgatttaatctt

SEQ ID NO: 69258 - DNA, 1554 bp, Homo sapiens
  misc_feature (1440)..(1440): n is a, c, g, or t
ataggtcaggtagcgaggccggtgtctgatgaagtccaccagccgggatggccgtgctgtatttctctgaatccctcgtgcccacggcaaggaaggctttgtgtgacccactggaggaggtcagagaggcggcagccaagactttcgagcagctgcattccaccatcggccaccaggctctggaggacattctcccatttttactaaagcagctggatgacgaggaggtgtcagagtttgccttggatggtctgaagcaagtcatggctattaagagtcgtgtggtgctgccctaccttgtgcccaagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggagatggccaattgtcaggctgtgatcctctccgtagaggatgacacagggcaccggatcatcatcgaggatctgctggaggccacccgcagccctgaggtgggcatgaggcaagctacaccacatcgagacaggcggagggcagttgccggccaaactttccagcctgttcgttaagtgtctgcagaacccatccagcgacatcaggctggtggctgagaagatgatctggtgggcaaataaggacccactgcctcccctggacccccaggccatcaagcccatcctgaaggctcttcttgacaacaccaaggataagaacaccgtggtcagggcctacagcgaccaggcaattgtcaacctcctcaagatgcggcagggtgaagaggtgtttcagtccctctccaagatcctggatgtggccagtttggaggtgctgaacgaggttaaccgaaggtccctgaagaagctggccagccaggccgactccacggagcaggtggacgacaccatcctgacatgagaggcctgggccagcagcagcattgccgctccacatctttgctcaatgttttcatttttgaaaatacatttgttccaatggggagcttggaagatggcgttcccagaaagtattttaatatcaatagaccacagccaaagccttaaatcaaacccacacacaactgaaaattgcctcctccatctctcaccttttcctgtggagaagagaaggaaaagcacacgcatgcgcctcagcaaatggcagcccaggagctgtttgtccagtttagcatggctaggtctggaactataatagcagggtcagactgtgggttcctcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctganccctgtcagatgaaaatgattcacagctctggcagttcccaagtctggggaggggtataggtttgaaaggctgtttgaaagaggaatgtttaataaaggctttgatttaatctt

SEQ ID NO: 69259 - DNA, 208 bp, Homo sapiens
caaatacttggaaacttaaaacaggaagaggtgtcagaatgaatgctcttgggggcaatgggctggagggggagctctttagaaagttactgaaggctgaataaaaatatttactgttttggactgtgtatataaagccttctgtattttatgagacttagtgaaatacttcttgaaacagctcctactgcatttaaatatatgcttt

SEQ ID NO: 69260 - DNA, 276 bp, Homo sapiens
gagcaaagccattccaagctgcagggctctgggctgacttccaacttggaacagagcttttctaattatcgcttttacttttgactttgtggaggatatctctgaagaaaggagttattgcttaacaaatattacttagtacttaccacatggcagacatggggatgtttttaaacattgaaaaccaaagctttagagtagtatctgcttgtccatctggctgcctcacaatcatcccaggagactgccccagaatctgaatatttaagattcttg

SEQ ID NO: 69261 - DNA, 440 bp, Homo sapiens
gaaggaaggaagaaagagagaaaggaatcaccttctatataatgcaaaatggtaataataatataacaacataaggtaacctataatatagcataataatttgatatgctatgctgtagacattttacataactatcttggttattgtctgccctccccaaaataatggacactcatcagggcaggaacttctgtctttatgtttactactgtatcctcagcaccaagaacagcattgctgaaggaggcaagaaggaacatcaatgcaatttacaagctgatgatcttgggacagcattcattcactcaaaaattacttgtgggctgggagcattggctcacgactgtaatcccgtactttgggaggctgaggtgggagggtcgcttgagcccaggcattcaagaccagcctaggcaacataataagactctatctctac

SEQ ID NO: 69262 - DNA, 463 bp, Homo sapiens
aaacatcaggctaaagagaccctgaacaccagagcagcatttccaggaaatattcattggtcttaaccatcttatttatgtaaagcaggtgaagttttttggaaaaaaataaaaacctgaagcttacctaacaaagcctatgccttggcagctcccatcctcgtttgttctctttctttgctggcatgaatgttcagataacccaaaaggttttatgaaaatattctaacctctgagttcaggtctgctgtttctgaaaatcatttttgtgagaataacaagacaaataaaaacaattagtatatatctgtgtgactgtgcagtgagcaaagcatacacctgtgcctgcagtggcaaaagtggttctgttcttaaaagaatcagttttggccaggtgtggtggctcacgcctgtaatcccagcactttgggaggcagaggtgggtggatcacaaggtcaggag

SEQ ID NO: 69263 - DNA, 319 bp, Homo sapiens
taaaagtatgatgtttattgtagaatcaattgaatgaatatatttaataaaatgggaagataggttttttttttttaacatttatgtgaaattatattttgtctgttcatagctctataaatagctaatgaaggttcctttgtgccagatctaacaggtatgggattggacgctgttgttttctggcttgactttttaatttttatcattcttcatgtgtcttacatactatagtagctgctgcttgtcaataaaatacccatttggggtacaggagttaatttatcaaagctttcctcagaagaaagctgatacctgg

SEQ ID NO: 69264 - DNA, 903 bp, Homo sapiens
ttctccccgccttgtggcagtgaaccatgacccctgaagcccatgttagagccaggagttggggtggggggcattgcaactaaagaccagggctccacctcctgtcctgagccccaatgtggctagcagagccaccagacggtgagagtgaatcctgtgcccagcactgccctaccagatcttacaccatccttgcagccagctgactaggctgtggtcagcaaacccatttcacagatggggaaactgaggggcattagcaaggtaaggattgaaacccagatctggctccacatcttatgatttctcccttctacccattagctgggagcaccatcaggccaggatggctcatggtggcagcccctatacccctggctgggcagaggaggtgctgacaattactggctgaatgaatgaataaaggaaggaacaaaccacaccttccctggccttactaagatgcaatgaggtgttcttccagagggaattttggagggaaccaaggggagatgaaaggtactcaggagtggggattaggtgggacccagcaataactaacttggaatgaactaacccagaatagccagacctagttggttattcacactgcaatttgggcctttttcagtttttgttcaagtctgattatatcaaggaaaaggtcttggtttgaggctaacatgtctttaatgactgtaacatttgtcactgtctctttttaatagagagaaggtctcaaactcagggctgttgacatcagcgtgctagaatgtactgatagcgctttgttttctttgtacttgccgttactttctggttttggcaagtgctactggttttccatgtacagtaatgatgtaaagcttccttgataaatgcattgattgaagtcctttaaaa

SEQ ID NO: 69265 - DNA, 326 bp, Homo sapiens
gcccaggctgcagtgagccatgattgtgtcactgcacgccagcgtggatgacaagcaagaccctgtctcaaaaaacaaaaaaatatggtttcacaaaaatgggaacagcatgggaaacagacagcccctaaatcccctctctgacggtcatcataatcagcagttcgatgtgcatcctcccatgtttatgtgtttgcatatatatatgaatctaaataactatataaatatatatgtatgaatatacatatagttatatatgtaatatatgtgtgaaattatatatttacataaattgaactatatgtatgcagtgtttatcactt

SEQ ID NO: 69266 - DNA, 4491 bp, Homo sapiens
  misc_feature (3285)..(3285): n is a, c, g, or t
  misc_feature (3720)..(3720): n is a, c, g, or t
  misc_feature (4471)..(4471): n is a, c, g, or t
ggaagatggagagaatcaggccatcactgggaaggaccatagggtggtacagactaggagaacaggaagcatgaattctaaataatcaggagtacagagacttcaataagcatgttagggaagtcagaactcgttaagttcacaatccattgtacatttactttcttactgatctttaactgtcagccactgttcatctccatcaaatgctgttcctctctggatagaacagcagacctggcttgtgcatttccggagaatggggaagttcagaaagcccccagactgtcagccagctgacttcctttttactgggctttttctctgtgcgaataagcaaaggaatcacacacggacagatggttgggtgggtgttcttgatagcgtgtatttggaagttactgtcaagtcagggtgcatgaggcataattccccctctgatttgctttccagtgggaacttttgtgtctgagagagagtgggagagtaaggagggttcatttccccacaaatcttttactcaaactgtctggcttctcagactatacctctagtcgctgagctaccttgagagtggtaccatttcatactagctaggagagtcttcatgttaattcctttgctcagtgagttcagcagtttacagggcagacattttccttcatttgattctctgtgagatgctgtgttaggtctaggggcttcattggacaatgggcacaaatcctggctgtatggggttgggagttggtggtctctctgcgggtggtggtaggtggtaggtggggaggcatctgggtggcacagactgtggaacaaagtagttgtgttatagtggaagctgggtggcttttcttcttggcggtgaaactgtgtctttgaagacattgcactttggcacctgtgccttgctaaggatttcatccctatcttgtctttgtcctgagattatatctcaggacctgccaattttgccagaaatgtcaagttaccatgcactgaaaaatctcagacagccaagaaatgtactatttttgctagcatcaagagcctaagtgataagagtgtccaggtggtggccactgctgcccctgggatatctcaggcctcctgcttgactgggaggcagcagccacgccagctgtttgggccccactcacaccagggcccccattgcattggagtctgccctactgtggaatttgggatgctgcccttgttgcattcgctctgctttgagtacttggtgcttcctaaaagagcacagcaagtgttctttgcaggtgatattgttcatgccctcaccttgtttagactctaaatggtacctgaaatggcataggttatcagtgtttattagctaaggcatggctcagccttgagtccctctcaagagctacaggaaaggcctttgcattgtctctaaatgatcctttgctgcttattttaatcacagaagccttaaggggactgatagttgtatgaagggtaggagcttgtttagcaggcaggacatattgtcattttagattcataacccttcattcctaaattagattgaaaatctgagcagctctgtgacatctacagtattgacattctcggttttgtgttcatgggttgccaacacagagcatactccgacaaaactgtaaaattgtatataacttaagaatgaatttttatgattggaggctctcctgtattgtacaagtcatcttattttggggttgcagatagtaataaatacagaagttttataaacttacatttggaaattaaataaagaaaaatcactaaggaagtatatgcttcaaaccaaaaatgaagctactcagattttcctaatttaaacataatgtattttcccattcttttccctaagacaatggtatctatcccctgtgctagagaaagtagtgtgatgtggttattgttatttagacccacttggaagttcctgagggacatggcgagggtggatggacttgtctgcctgtgtagcagtgtggaagccatgttttaggaaagaagtggtgggacatggagagaaagcaggtaagagagttgtgaatggggtagggtgacttctacaagtacacagttctgacgttctccttgcctttcagttgcaactctaactcatcagtgatgataggccgtcaggaaaatcctctttgtggatgttataaaccctaaataccaccctgtaaagaattcgcctcctcatgggagcagatgggatggccatacctaacacttgtctcttattgttaagcaaagccccatcttggtctttaaatcatttcctgtgagataggctctgaacatgtggcttttgaaaatccctttcttagggcccttggtttagaaattgcttgccttttctgtttgagattgggagccaggtttatcttaattcattctgtgtcacaaatgagacagaggacttgttactgcagacctacaatttttgtctggagaaaaggtatgaaagggatcagaatctcccctcctcaactccagcagtggcctgatctggcccctagagacctgactacaaggtgtggacagttcctctgttgtctactgtccaccttcaagggatcaaacccagttctgaaacccacaacctgtcagagcagagaagaacccaccatcaggcaaaaggactagacatagggcaggtggaatctaagaatatcttggcactacattgggtgaggaatatagaatgtggggagacttctgattggtctctgccccttggcacgctgaaattcctgactcatgaagggcaggacatgtgtttttcctcactctgttcccaacgtttagcacaatgcctggcacatagcagaagcccagtaaatatgtacttaaagcccgttagaattagtggtgctttccgttctgaatagattgggacagcctatggatcttgaaaggcataagcaaccaagggtgttagactctgtagctattaattaccaaacaaaattatagtcttgtactctaagaagcagccatgtcttgagtgagaaggcttaggatatgaggactagatatcagcaaggataccataggtttggaaagacattttaatttacccttagaatacacaactttactgatttttaaggatgatcagcccatcatatagcactttattttttcttttaaagacaatcctgtttcatttaccttcacttgacacaggagtttgagaagtcctgggcaggtatacctggttattttgtcattggtagtctttttaacttttanaaaataatcctagtaaactaaacctgagcctctgaataagatgttgtctgcctttgtagctatatgagaagagtggcagaccacagcttttgacggggatttttgaataaaataactaaaaccaacaatacagcaaaagctcatctgggaaaaggacaaagagtaaactagtaaaatgtaaggctgtaaggaaaggggtagaagatcagaggaattctcatcaaaatattgcaaattatcccctgaacacaaactggtaacggtggtttgcttaagggaaggaaattcggagattagggatactgggtgaaaggcagattcttttttttaccatatattcctttgtatcttttaaattttgtattacattcgtgatctttcagaaataaataaataaaaatgcagtagcttcctgatcagaaagagggaataatngctgtcacttgcgtttcagaaacatagcatccaaactgatgtgattatggtgacctgtcccacttagttttgctgatgtactataattactttctccagtgaggctgacttcagaaacagttgcagatgcagaattttaatccagggtatgctgtatataagtaacttttgcatttacaatctaccatttggcgttttatggctaataatccacaaatatctaaactaatttataaaggcaaaaactactgatttaatgtagtactctgcttctgtatccccgaggtgagtcagaaaaatttcaagttgccacgccttggccagaccccacagtatattggttattggtcctgaagttagttctttaaaataacttgaaatgtttcatgcttagttctaggatctatactttctttgatttgactgggactgaaaggctcagaataactgaatatccttggctctaaataagaagctgtaactttgggccaggtgcagtgcctcatgcctttgggaggccaaggcaggaaggtagcttgaagtcaggaatttaagacagtctgggcaacatagtgagacccccatctctataaatgctttttaaaagtagcagggcatggtggcatgtgcctgcaatctcagctacttggatgggtgagttgggagcgtcgcttgagcccaggagttctgagctgcagtgagctgtggttgcactactgagctgtgattgcactcaaggctgggccacagngtgagaccctgtatttaaag

SEQ ID NO: 69267 - DNA, 368 bp, Homo sapiens
actaaatcagtttctaagaaactaagtcagtttattaggtattagggttatcgtctgtatatttgtgtgctttagatgttaaaagtggataaaaatccagccgtccttttctaaataattctgactggcatttctccttaatctagtttatttgtagaaatttttgtataggaatctttttctcctttggaaataatgttctactccatggtctgttagtaacaatcatttaggattttttgccaggtgttcagttcacacatgtattacatgctgttcggcaaattctatctcatgatgtaagactgacttaattttcctctactttgtgtctgtagctttgtgtgcatgtgttagggttttacctt

SEQ ID NO: 69268 - DNA, 288 bp, Homo sapiens
aggtctataccctgctgctattgtaatagacttttgctgcaatcttttggtattgtacagtttcaaaagaacactatatcttctgataccctgtgaaataaaaataacaattttctttagcacaattatttttccagtggaaatgctgaaaattaaaagcatattaatatgtttctactgttagtgagttgcttttgcttcttttgggacagagagtaatgaatgagcactgaggtattgagggctcctgcagttaatagccagagaaggtcttaatttaagatactc

SEQ ID NO: 69269 - DNA, 142 bp, Homo sapiens
agcccaggttctgtcttcaagaagccatagctgctgagaactaatgaaagggaaagacctcacccatactcgggaactgaacagatgcttgggaatgtgtgcacctgcgggcacacgcgcacactggcagaaaacttcaggg

SEQ ID NO: 69270 - DNA, 338 bp, Homo sapiens
ggtcgaccggaagtgacgggagaaacacgctgtggttagtgattaaagactggacataaaattgtctccaaacccattttttaaaagtctttgaacatgaccaaaattgtattaacgagctttggctggaaagaacactacagtgttctctatctccatttctcacattttagttaaacttataaacccttcccccagatgggcttcccctggtaaccatattaaacagaaacattagacagaatcagtaagaaaatgttcacatttgtaatcccagcactttgggaggccgaggggggcagatcacctgaggtcaggaattctcaactagcctgacc

SEQ ID NO: 69271 - DNA, 347 bp, Homo sapiens
gacatattggaaagcaatttggcactgtcaactaatagtgtgtgtgtctctcttatgagttattgtatctagtgtggtgttactggatgctgaaaaacacttcatgaatacttcttgcattcaaaatttcatcaagaataatcaacatgttcagttttatttctgttcattttttcttgcatggtgagctttgagaccttgtacaaaatccctgatctttctgggcctcatctgtgaagattatgatgatcacggagccctgtgacacattcctcagagatccaggtgctggctggtgaggagctggacaggtgctctgtgctgaaattcaccaaagttgtgaaggg

SEQ ID NO: 69272 - DNA, 116 bp, Homo sapiens
tgctgttagattatcttctgagcaatttcaagttttaagaatatgttggtgaagtcaacaatgaacaattccaggagacttggttccacccgggccctgctcaggaaagatgagga

SEQ ID NO: 69273 - DNA, 405 bp, Homo sapiens
tgagatggagaaggtgaatactagtaaaagactacattgatatgctgtaggcacttgaggtttctgtttgtttgtttgtttgtttttttggaaaccttcgagagacttatggaaaacactgtataattgtttcattgaggagcacggaactgatcatgtttattcaccaactctcatgcctttttggttgaaggatgctcctaggggcattcacacctgctctgaactccttcttcatctccagcctgcctcccttatgggccatttcatgccactgtacctagataaagccttagggccaagagattcaggtgcttgaggctgggtctatccttctgagctgcaaataacttccagggtggatcaagggaatgtggggtcaggatagattatattgcctctcat

SEQ ID NO: 69274 - DNA, 967 bp, Homo sapiens
  misc_feature (24)..(24): n is a, c, g, or t
gggggaacacccattgattcagtnacctgcccccaggtctctgccaccacacatggggattatgggaactacaactcaagatgagatttgggtggggacacaggcaaattatatcagctgttgtgctcattagtttgtatatcatccttggctcctttagcactataagggcaggattgagtccttgcaacagaaaccattcagcctgcaaagctgaacctatttacctggtaaaccttttcctgtcttcaccatccccatgcagcattttccatattcctgtatgtatgttttgagagtggataaggaaggatgagttctgctgtgttcatttcagcatcattttctttacacttgctttgttgctaggaggtgttacagttctcatttttacttacggtgcagtgtcagtaaataggtccttagccaccttgttgctggacttggattatattttgtccactgtgatcagggctgcccctggcaccagtgttgtgatcttcattggcttctattgtggcattagcttccttgggcagataaccatggaggggtccataatatccttaaataccattggtgtggctttaagtggcttttgtttgttttactttgcttgaaaaaattttttaggcctggtacggtggctcattgccaggattataggcatgggccattgtgcctggctagctttttctttaaagccgtattcgtgtcctcttgccactgtaaaaaataaccacaaacttcgtggtgtcaaacaaaacaaatttagtctggctaacatggtgagaccttgtctctactaaaaatacaaaaacttagctgggtgtggtggcgcatgcctgtaattccagctacatgggaagctgaggcaggagaatcgcttgaacccgggaggcagaggttgcagtgagtcgaggtcataccactgtactccagcctgggtgacagagtgagactctca

SEQ ID NO: 69275 - DNA, 850 bp, Homo sapiens
gttcgatgaagccccgtctctactaaaaatacaaaaattagccaggtgtggtggcgcacgcctgtggtcccagctactcgggaggctccacctcccgggttcaagtgattctcctgcctcagcctcccgagtacctgggattacaggcacccgccaccagcctggtaaaccttttcctgtcttcaccatccccatgcagcattttccatattcctgtatgtatgttttgagagtggataaggaaggatgagttctgctgtgttcatttcagcatcattttctttacacttgctttgttgctaggaggtgttacagttctcatttttacttacggtgcagtgtcagtaaataggtccttagccaccttgttgctggacttggattatattttgtccactgtgatcagggctgcccctggcaccagtgttgtgatcttcattggcttctattgtggcattagcttccttgggcagataaccatggaggggtccataatatccttaaataccattggtgtggctttaagtggcttttgtttgttttactttgcttgaaaaaattttttaggcctggtacggtggctcatgcctgtaatcccagcactttaggaggctgaggtgggtagatcacttgaggccaggagttcaataccagcctggccaatatggtgaaaccctatctctactaaacatacatatattagctgggcatagtggcacatgcctgtagtcccagctactcaggagactgaggtagaggaatcacttgaactcgggaggcggaggttacagtgagccgagtggtgcacttcagcctgagtgacacagtgagacccctgtctcaaaaaaga

SEQ ID NO: 69276 - DNA, 2772 bp, Homo sapiens
cgtcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttg

SEQ ID NO: 69277 - DNA, 1061 bp, Homo sapiens
ctggttttcctgcaggtcagcaagggtggctgggattagcaagcgctcagtcaagcgatggttcatctctgaatgaatgaacatttagcttccttatcagaccccgaagcgttaaggacctccacataatcttgaaagtggcatcgtttgactgcctcggccctagggtgtggcagacaccctgctgtgtccctggataatctgtgcttcttgctttggccagctaagaaagtgctgcgttgctgatgcatttttaaggtctgtttctctctttgttctggggctgttcttgcagctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggcaagagaacccgctattatctcgtctgcaggccagtcggactggtccgggtgacctgctcactaactctggcctctgcttctctttcctttgtgttgctgtagcccccggctccactgagttaaggcacacttagtccaggtagttacaaagctctcctacaacatttctcttacttggttccaaaacagtccagtggggtaggggatgttatttccattaaaagatggggagccaagggcctggcgccgtggctcacgcctgtaatcccagcattttggggaagccgaggcgggcggatcatttgaggccaggagtttgagaccagcctggccaacatggtgaaaccccatctctacctaaaagtaccaaaattacctgagcacggtggcacgcacctgtaatcccagctacttgggaggctgaggcaggagaatcgcttgaacctgggtggcagaggttgcagtgagctgagatcgcgccaccgtactcggtctcaa

SEQ ID NO: 69278 - DNA, 2806 bp, Homo sapiens
ctggttttcctgcaggtcagcaagggtggctgggattagcaagcgctcagtcaagcgatggttcatctctgaatgaatgaacatttagcttccttatcagaccccgaagcgttaaggacctccacataatcttgaaagtggcatcgtttgactgcctcggccctagggtgtggcagacaccctgctgtgtccctggataatctgtgcttcttgctttggccagctaagaaagtgctgcgttgctgatgcatttttaaggtctgtttctctctttgttctggggctgttcttgcagctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttg

SEQ ID NO: 69279 - DNA, 2500 bp, Homo sapiens
acctttaaaaagtcagatttaatagtcatttgagttaggaaaaaacttctctgcattttagcatctatctctgccaatttccactttttagagataaggttttagaaaagctgctacctagcgagtgggggtgagggtgccattctaagagctctgacctcgtccttcagtgcatgaggagcagatggagcctgcgcgcctcttggtgcaccctttgagcttcgcatcctgtttcttctttcatggttggtccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttg

SEQ ID NO: 69280 - DNA, 2546 bp, Homo sapiens
cgtcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttg

SEQ ID NO: 69281 - DNA, 1550 bp, Homo sapiens
ttgtcttttggtttttatgaggtgggatatccctatgctgcctaggctgaccttgaactcctgggctcaagcagtctacccacctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttg

SEQ ID NO: 69282 - DNA, 2028 bp, Homo sapiens
cgtcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggcaagagaacccgctattatctcgtctgcaggccagtcggactggtccgggtgacctgctcactaactctggcctctgcttctctttcctttgtgttgctgtagcccccggctccactgagttaaggcacacttagtccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacaagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttg

SEQ ID NO: 69283 - DNA, 1759 bp, Homo sapiens
cgtcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttg

SEQ ID NO: 69284 - DNA, 1813 bp, Homo sapiens
cgtcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcagcataggggcactgggggtcttatacgtctttaaaataattataactgtgacttgtatgtacactatatttaccctcctttgatttatacttaagttaaaatacggggctcgaagtgccatactggagtcagtacttgtaggatgttgctcgtggccggcctg

SEQ ID NO: 69285 - DNA, 1542 bp, Homo sapiens
cgtcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggcaagagaacccgctattatctcgtctgcaggccagtcggactggtccgggtgacctgctcactaactctggcctctgcttctctttcctttgtgttgctgtagcccccggctccactgagttaaggcacacttagtccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcaggtcagcgggaggcggttttttggggcacacaagcccttcattctctcaatgataaaatgaggtcctgaggaccatcagcactttgtttaccaggacgaaagtgcctgcttggcacaaggcacttacctactgctttacttttcctttgccagtctcagcatggcacacagtgtgggttgtggaaatgaactaaagaaataatcactgggccaggcgcggtggctcacacctgtaatcccagcactttgggaggccatggcgggcggatcaccaggagatcgagaccatcctggctaacatggtgaaaccctgtctctactaaaaatacaaaaattagccgggcgtggtggcgggcgcctgtagtcccatctactcgggagactgaggcaagagaatggcgtgaacccgggaggcggagcttgcagtgagccgggatcacaccactgcactccagcctgggtgacagagtgagactctgtctcaaaaaaaaaaaaaagaaataatcactgatggaagcaaaatgcgccagtcttgctcccatcaggtcagagccaagaattatggcaggattatcccttagattttaacactaatttttcttaaaagttatccaagatgctgatgggacgaaaacacatttggcgtcccatcagagattggacagtcaatttcctgaatggctatgtgtctgggttcat

SEQ ID NO: 69286 - DNA, 314 bp, Homo sapiens
aaagccacaggatcccactggatttcctcactttgctaaagtcaggaattttcttagggcatactgtgctagaaaccagtgagtgagtgtccagctgagtcctgcatgggcttgttgcacactgacaagagactctctcaaggggtacggacatgaggaatgtgctgagggtcgggactggagcttggccaggtggcggtggtggcaggaaacccagctgtgtcttgttctgcaggtggcctgtggcacagtggactgatcgacaaaaacctcattgattactttatccccttcctgcctttggagtacagaca

SEQ ID NO: 69287 - DNA, 2913 bp, Homo sapiens
cgtcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggcaagagaacccgctattatctcgtctgcaggccagtcggactggtccgggtgacctgctcactaactctggcctctgcttctctttcctttgtgttgctgtagcccccggctccactgagttaaggcacacttagtccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttg

SEQ ID NO: 69288 - DNA, 2681 bp, Homo sapiens
ctggttttcctgcaggtcagcaagggtggctgggattagcaagcgctcagtcaagcgatggttcatctctgaatgaatgaacatttagcttccttatcagaccccgaagcgttaaggacctccacataatcttgaaagtggcatcgtttgactgcctcggccctagggtgtggcagacaccctgctgtgtccctggataatctgtgcttcttgctttggccagctaagaaagtgctgcgttgctgatgcatttttaaggtctgtttctctctttgttctggggctgttcttgcagctctcaagctggatttggaggagaagctgtttggacagcatctagccacggaagtgattttcaaggcgctgactggcttcaggaacaacaaaaatcccaagaaaccactgaccctttccttacacggctgggctggcacaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttg

SEQ ID NO: 69289 - DNA, 2465 bp, Homo sapiens
cgtcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggactttgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttg

SEQ ID NO: 69290 - DNA, 1583 bp, Homo sapiens
cgtcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccagagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttg

SEQ ID NO: 69291 - DNA, 3254 bp, Homo sapiens
cgtcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttggactgccgttactgatttgtaacttgaaaaggctatggttgatcatgaccccgcctcccccacctcccttataagatgtggacgagagctttattgacctactgactataaaatagtaaattctagattttatcatgtgaaatgccacttgctaactttttctagtttatttggttccaaagttcagaatgaatttcagcagcacagctgtgagactcaccatatccgggacaggcgggtgggcagtcagcgcgatacagaagcaatatttaccttaaaggctcttccccagacaaatagaagttaaattagctgatggatatttcatcaaagagatggactttctcccaaaattaacgtgggaggaaattgaggtactggtaaagtaaaactcacctctgacagcctgaacctgagctcaggtgaggaaacctaaccattgaaactggtaaataaatcctggccgggtgcggtggctcaca

SEQ ID NO: 69292 - DNA, 2956 bp, Homo sapiens
  misc_feature (2895)..(2895): n is a, c, g, or t
  misc_feature (2917)..(2917): n is a, c, g, or t
  misc_feature (2940)..(2940): n is a, c, g, or t
cgtcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttgaatcacaatgagaccgttggctttgaatttgagtcgttggttcccatggtgagatgcttgttaagactttatacttgggtcaatctctcactttattttgtagaaccatttgaaatcctaggatgtgcttgttctggaaggatgacatgggcccagactgaacaagtcagcttgatgatcttaaatgatggaagtataggacgttgcttattttaaaacaagggaaggacacaaaatggaatgactgcttagtcctttctcagatactcttaaaacaattttttattgttaaatttgtggtaatacatggtcacaaccgtggatcaaacaaggtcagtctaaagtggcaggtcctaggtgtgacctgataccaccaccctttgtggcagcaccgggctggactgccctgatccctgggacgtgagacttagcttccagccagtgtgaatcattgtatctgtctcataatcacagcacagctgcagacacaacaacgtgcagcattttttacataaaaatatggtagaattaatttatgacatggaaatgccttacgtggtatcacacttagtcttgaaaaaaacaccaaggtgacgtttaaaatttttagtacatatcctcaaattggagctaagttatacttcttttataaccttttgggcatctggtcgagagaagacaagattttctctatttacagtgaggcaataaatatgtttgccacctttgctcgtgcgaaatccgcacgaggaactagtctcgagttttttttttttttttttggtcaattataatttatttaagagcttgggcccagttttataatcttacaagaatgaagcagggaccaanggtaagtgcaacccttcctgcncactggggttcctgcgcttcaancctgggtggcaatttt

SEQ ID NO: 69293 - DNA, 2067 bp, Homo sapiens
cgtcctgccgcttggccgcggggcgcctggctcagtggcttctgcgggcttcgaggagcgggatgttgcgggctgggtggctccggggcgcggcggcgctggcgctgctgctggcggcccgagtggtggcggcgttcgagcccatcaccgtgggcctagccatcggggccgcgtcggccatcaccggctacctgtcctacaatgacatctactgccgcttcgccgagtgctgccgcgaggagcggccgctcaacgcttcggctctcaagctggatttggaggagaagctgtttggacagcatctagccacggaagtgattttcaaggcgctgactggcttcaggaacaacaaaaatcccaagaaaccactgaccctttccttacacggctgggctggcacaggcaagaattttgtcagtcaaattgtggctgaaaatcttcacccaaaaggtctgaagagtaactttgtccacctgtttgtatcgactctgcacttccctcatgagcagaagataaaactgtaccaggaccagttacagaagtggatccgcggtaatgtgagtgcatgtgcgaactctgttttcatatttgacgagatggataaattgcaccccgggatcattgacgcaatcaagccgtttctagactactacgagcaggttgacggagtgtcttaccgcaaagccatcttcatctttctcagcaatgcaggcggggaccttataactaagacggctcttgacttttggcgggccggaagaaagagggaagacattcagctgaaggacctggaacctgtactgtctgtcggagtcttcaataataaacacagtggcctgtggcacagtggactgatcgacaaaaacctcattgattactttatccccttcctgcctttggagtacagacatgtgaaaatgtgtgtgagggccgagatgagggcccgtggttctgccatagatgaagacattgtcacaagagtggcagaggaaatgacgtttttccccagagacgagaaaatctactcagacaagggctgcaagactgtgcagtcgcggctggatttccactgagctcctatccagatggggtaggagacagctgggaggctccgcacgccagaggccttgcctttcagaagaaccctgaagaccgctttggggttttgcctgtttgcaccttagacttttgggtatagaatcttttttttgagaagaggtctcactccgtcatccaagctggagtgcagtggtgcaatcctcaactcactgcaacctccgctcccggtttgagtgattctcatgcctcagcctcccgagtagctgggattacaggcatgagccactgtgcccagctgggatatagaatctaagagttgattgtggaaaacacgtgaatctattgcgcgcatttgtcatttagcaagatggcagcagtccagctgttctttgcagctggagatgaacttttaaaaatccccttcacacttaatgtactgaccgagacagaagtacctgaaaacagctgtgcatggcaggcccggcaatagcttctgacccacagcacccgcgcctcagaagctacggtcacaactaaaggagtccagggacttgctgcaggctggggggcactgggtggttctcaccagcaggctgcggggcactgtgttctcattggccaaaaacatccttttgctctgtctcgttctttacacagagttcactgacttgaagtatactcagttaaaatcggggctggaggtgcagacggtgtctgaccggaggatgtggccgtgcccgccgagcactcttgatctgagctgacctgtgtgtgtgtgtgggggggggtggggccttcacctaagacctctgcagcagacctggacagacaggcccctcccgcctgtccatcgctctagctgctaatacagccctggctgtggaatccttcaccgtctcagctggtatcagccccagcctgccttgtgccatatctcagcttggatctctgctagagtccccccaaccatatatcatagagttggggggactctagcagagatccagg

SEQ ID NO: 69294 - DNA, 427 bp, Homo sapiens
caggaagggtctggcttctcagagtcactcagcatttatagttcttaaacagtttcagtggaatgggggagttggaatgaagcccgttggcaagtcctgctgtaagggggagaatctctctttcataataactttgccaggacccctcccccacgaagggaccctttgtgctagtgcctcgcttccaactggaggcttgatgtgttgcgtgctgaacctgcaaacatctccacttcaggcattagctcatcaccttctgccttccccttcaggtcaagcaagggatgagagcctcgcttacgaacagacaaatatagaggaaaacgagggagtgctttctcatcttttcattcaggttgcagagtctcattcttctcagtcccagaattccagaagttttattgttaggaagaaagaagatgatatc

SEQ ID NO: 69295 - DNA, 1064 bp, Homo sapiens
tctcttttcctccttgctaagtacagttattaagtctggaaataatgtaagaggcaatcaagtgagaactacaaaaaatagaaagaggaaggcagactggctagggaccctagtacaggaaaaacaacacagtgacagagtctcttatgacccacacccaacagcaaacctggtctaggcccccactctcaacctagcaacataaggtgacacaggtaggcttattctttccccagattaaacaagagccctgccaacactaggcaagtctggtggctctagcaagggggaattgatttggaaccactggcaatcagtgaccagggagaagcattctccttccctcctgggcatgagactccccttccccactgacagacactgggtggccagtgtgcctggcaagggggatgtcctcacaaatgcctagcccagaaagtgatctttgttcctgtcacctggagactcctttctctcccctaaaggtaccagatgacccaacctgaggaagctctctttccccctactgtaaggcaccagtgtggactgtggactagtgggaacccaacgggcaccaaatgctagatgacgagttagtgggtgcagcgcaccagcatggcacatgtatacatatgtaactaacctgcacaatgtgcacatgtaccctaaaacttaaagtataattaaaaaataataataataatagtaataataaaaaaaaaagaaaaaaaaattcagacacacctaaatgattgtgaatgctttgaaaattgtcatccaaaccacagcccacaaaagtaggccaggacctgtgtgataaacctaaatggggatatgccttctaatggcaaagatttctgtaggacccagagtcttgtaagttatagtgaaaatattgaggataaaataaaaaatcacccatcataccaaaaccaagaaaatcacaacttgaataagaaaaaggaatgacaacactaagatgaatcagatttggaattatctggcaaggatttttaaagcaaacatcataaaaatgctctaacaaataattacaaagtatcttg

SEQ ID NO: 69296 - DNA, 645 bp, Homo sapiens
gtggtagctatttttaaatgtcttgatttttcctcaagatagtcccagcatttacaaccttatgtatcccccttaaagaaacacgcacaaaaaatgaaaagcttaggatacagtctacaccttgcttttttcagtgtcttggagatggctttctattagcctgtaagatctacctcatttttttcactgctttgtgatatccattgtatgaatgtaccataattcatacagtccccctgttgatgggcctctaggttcttttctgccttttgctattacaaacagtactgtgccaaatatccccgcacactgtccctggataaattgatgaaattaaatcgtaggtgcatttgttattttgatagaaattggaaatgtagttcccagtgtgtgtatgaaaatgttcattcccctgaatcctctgaaactattgtgttgtttctgatctcataaatgaaaaatgctctcatattttaatttgcattcaactatgagtgaaactgggtaccacagcccatgtttaaaagtcatttgtatttattttctgtgactggcttatttgcgttctttagcagtttttctgttcatccttttaataatcaatttgtacaaactataaagaaattatccttatctgctatatgt

SEQ ID NO: 69297 - DNA, 5611 bp, Homo sapiens
tcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagaattttaccttcaatgatgacttcagtcccagcagtaccagttcagcagacctcagcggcttaggagcagaacctaaaacaccagggctctctcagtccttagcactgtcatcagatgagagcctggatatgatagatgacgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatccttt

SEQ ID NO: 69298 - DNA, 2871 bp, Homo sapiens
agtataagaaaaccacatgtacgagtagtgaaaggagtatgaaataacttgaaaattgagtcatgtaacaacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatccttt

SEQ ID NO: 69299 - DNA, 6259 bp, Homo sapiens
tcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagccatcaaacagtttctataaccacatgcatattaccaaattacttccacctaagggtttgagaacgtcttctccagaatcagattctggtgttccacccctcaccccggtggatagcaatgtgcccttctcgtctgaccacatagctgaatttcaagaagaaccactggacccagaaatggggcctctctcctctatgtggggagacacttcactgttttctacttcaaagtctgatcatgatgtggaagaatctccttgccatcaccaaaccaccaacaagaaaatattacgagaaaaagatgatgccaaagatcccaaatcactaagggcatccagttcattggcggtgcaaggaggaaaaattaagcggaagtttgtggatctgggggcgcctttgcgaaggaattccaacaagggaaagaagtggaaagaaaaagaaaaagaagccagtaggttttctgcaggtagcaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaagaattttaccttcaatgatgacttcagtcccagcagtaccagttcagcagacctcagcggcttaggagcagaacctaaaacaccagggctctctcagtccttagcactgtcatcagatgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatccttt

SEQ ID NO: 69300 - DNA, 6373 bp, Homo sapiens
tcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagccatcaaacagtttctataaccacatgcatattaccaaattacttccacctaagggtttgagaacgtcttctccagaatcagattctggtgttccacccctcaccccggtggatagcaatgtgcccttctcgtctgaccacatagctgaatttcaagaagaaccactggacccagaaatggggcctctctcctctatgtggggagacacttcactgttttctacttcaaagtctgatcatgatgtggaagaatctccttgccatcaccaaaccaccaacaagaaaatattacgagaaaaagatgatgccaaagatcccaaatcactaagggcatccagttcattggcggtgcaaggaggaaaaattaagcggaagtttgtggatctgggggcgcctttgcgaaggaattccaacaagggaaagaagtggaaagaaaaagaaaaagaagccagtaggttttctgcaggtagcaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaaggtagaaaacacatggattacaaaagcaaacaagagaaacccaaatccctcctcttcttcaatctttggaaggcattctcaacttatgtctgtagtctggatccaagaaaccaataattttaccttcaatgatgacttcagtcccagcagtaccagttcagcagacctcagcggcttaggagcagaacctaaaacaccagggctctctcagtccttagcactgtcatcagatgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatccttt

SEQ ID NO: 69301 - DNA, 6319 bp, Homo sapiens
tcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagccatcaaacagtttctataaccacatgcatattaccaaattacttccacctaagggtttgagaacgtcttctccagaatcagattctggtgttccacccctcaccccggtggatagcaatgtgcccttctcgtctgaccacatagctgaatttcaagaagaaccactggacccagaaatggggcctctctcctctatgtggggagacacttcactgttttctacttcaaagtctgatcatgatgtggaagaatctccttgccatcaccaaaccaccaacaagaaaatattacgagaaaaagatgatgccaaagatcccaaatcactaagggcatccagttcattggcggtgcaaggaggaaaaattaagcggaagtttgtggatctgggggcgcctttgcgaaggaattccaacaagggaaagaagtggaaagaaaaagaaaaagaagccagtaggttttctgcaggtagcaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaaggtagaaaacacatggattacaaaagcaaacaagagaaacccaaatccctcctcttcttcaatctttggaaggcattctcaacttatgtctgtagtctggatccaagaaaccaataattttaccttcaatgatgacttcagtcccagcagtaccagttcagcagacctcagcggcttaggagcagaacctaaaacaccagggctctctcagtccttagcactgtcatcagatgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactacttagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatccttt

SEQ ID NO: 69302 - DNA, 393 bp, Homo sapiens
aagtagaattgtgccctttttccattcattcacccattaattactcatttggaaagcatttaattaatgagctttagggtatactttgcaagggacttcaaagaacaaaagaaaaaataaagggtagcccccagtgtgttggtttttagcaaatgtaactagttcttcctctgttcttacctcttcaatgtttgaattagtttacgaacttggatatatggtatgttaacaccatcagagggctcattggttttcaaattcagtttgtgtgtgtgtttctttcttaggctcttggaatgacagcatcccaggaccgagcagtggtcaaaaagaaactcaaggaaatgaagatgtctctagagaaggctcggaaggcccaagagaaaatggaaa

SEQ ID NO: 69303 - DNA, 350 bp, Homo sapiens
gatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaaggtagaaaacacatggattacaaaagcaaacaagagaaacccaaatccctcctcttcttcaatctttggaaggcattctcaacttatgtctgtagtctggatccaagaaaccaatgtaataacactgcaataaacaatgcatggtatttctt

SEQ ID NO: 69304 - DNA, 3250 bp, Homo sapiens
  misc_feature (907)..(907): n is a, c, g, or t
  misc_feature (1462)..(1462): n is a, c, g, or t
gtaagaatagacaaccatagaatcaaaagtgtaatttacttcattcttttactgctccgttcatgctgagtattttgttttgtatattccttctcatgacaacaatgccaaaagaaaaactatgcttggaatgaacttgttaccatggtaatctcaaaattaaagtttcaaagtgttcaaatgttgccctcaaaaaaaaatcacaaataaaaatctactcagttttgtaaggtggatggcataacccttgttgcagcatgtacataatgacattcacctatcttgaactttagagagagtccaaatgtttctggtgtactgaaattctgtttagttcagttgaaataaatgggttataactatgcaattgctacagtatttgctgaaatgaaataccatgtcaatatataaagagaagctcattttcatcaagcaaagtagacatcaaaaaaactattttatatagcattgcttagacaaccaaattaaacaagtaatttttgtagatttaattatgtatgtcataactagagtatgccaactttctgtctcaataatcacattttaaaaatatattgattaaggaaaaaaagaagtctcatttgccagtgaacctttggatatttattaagataatttatggctttaatccaatttttaaaaatctttcatctatcttaaagtggcttcaagattttaaactctttcctgtggcttttatctttaattttatcctgtagtgaattgtaaaagtaatgaacaagggcaattggatgactcctcttacatatacactcaggaaagctctcagtcatctatatatccaaatttgtgtaaaatatatttgttattatattcattattataatattattatatttattttataaagtcacatatattaagntagaagcatttctgtttaaaaattatcaggcagtgacagtaggaaaacttgtaggcaagctaattaacaactagatccttcctatcattcaaggttttcacggatgctctcagtatttaaattatacattaatattgttaggcactgaataatcatctattctgaagttggaatttttgtttgtatcgtagattccattaaactttagtttttaatttttttttattattatactttaagttttagggtacatgtgcacattgtgcaggttagttacatatgtatacatgtgccatgctggtgtgctgcacccactaacttgtcatctagcattaggtgtatctcccaatgctatccctcccccctcccccgaccccacaacagtccccagagtgtgatgttccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcgttttntatggctgcatagtattccatggtgtatatgtgccacattttcttaatccagtctattattgttggacatttgggttggttccaagtctttgctattgtgaataatgccgcaatggttcaggatagagcttaacttctgcttgtgaaattttagtttagaatttttgttttattagattttttcaacattttaataaaaatgtataggcaaatgaaatcatgtaaagaatatgttgctcttttctataatatagtatgggaagctgtcacttctaaccaactacttttgtggtaagaaaacaaagagtaacactgaaaacacaatatgtgtttcagtaaaaattttcctatttgctcaataattcaatatttattatcatatttcatggtaatacatttctggaagtttatttaaaaatttatatttaaacaattaatttgtagtctgctccaaggaagtttcaaaaacatatgtgtattatgttttactgtttcattatcatctgttcattttcatccaaaagatatttttcttgtgattgggagacaccggatatcataatcaacatacaagttttatgcttttgataatatttgaaaagtgttttaacattgtagtttatagcaaatgacttaataattgatcctcaagtaagtgaagtggaaggttactcaatactaatggtagtaggcaatatagaatggatgtttggtagatacaacttgtgctccacaaactctcaattgcaagaaatgtttcatcattcatttttcttaaaatcaaatttcatctgattctggacgcttatcctagtgagttccctggaaattccatctaccattattgtaccacccttccctttctcccacctttccctcctgcccatttcagcctctaaaatttccagggatctaatgaagacacttgaggacttccactggtactgacttcactttggctgccatggatgagtagcagtgcttctgctgctattttgccctcctcctgggcatggaaatttttctcagaacttgattcagacacattcgtgtaccatgcagctatttccctatttcctgccctctcctactgtcagtgtgagttcctcaggcctacatcgccctctgcctccttccttttgaaaagtcttgccagctgtctagtccaagctcataatttatctctttctcttacctctccccaaactcccagccccgtttctgccagggctagtattgcttctcaatactattgcttcaggcttttataaaagaaaaaacatttaatatcccaaaaatcatataatgcagttactagttttatctctcttttatgaatgaggaaattgagggcagggcagatggagtagcatgcccaaggctacaaagctagaaagtgtcagaacccagatgtgaacacagcctagcaccagggagatccagttaccttgttgaatgggggaaaacaaatattagaataacatgcggtggctcatacctgtaatcccagcattttgggaggccaaggcgggtgggtcacctgaggtcaggagtttgagaccagcctcgccaacatggtgaaagcttatctctagtaaaaatccaaaaattagccaggacatggtggctcgtgcctgtaatctgagctactcgggaggctgaggcatgggagtctaagacagaagaatagaagaattgcttaaacccgggaggcagaggctgcaatgagctgagatcgtgccactgcactccagcctgggcaacaggctttttctgtgagactgcgtt

SEQ ID NO: 69305 - DNA, 243 bp, Homo sapiens
ttttttgagatggagtctcggtctgtcacccaggctggagtgcagtggcgcaatctcggctcactgcaagctctgcctgccgggttcactccattctcccacctcagcctcccgactacttgtgaggctgaggttggaggatcttatgagcctgggaagccaaggcctcagtgagcggtgattgcactaccgcactccagcctgggcaactgagcaagaccctgcctcaaaaatacaaaagac

SEQ ID NO: 69306 - DNA, 176 bp, Homo sapiens
ctattccagtggtctatatgctgcccttaggcctgtaccacactattttgattactgtggcttcgtagtaagttttgaaatcaaaaaggctgagtcctccagctttgctcttttttatgattgttttgactatttggagccccttgcaattccatttgaatttgaggattaacttt

SEQ ID NO: 69307 - DNA, 387 bp, Homo sapiens
cccagcccctaccccaaagacttaatataatcaacctttcttactcacctccccttccccaccacggtgatctgtttaggaatggacacatgacccatctgtgaccaatgagagtgaatttcaggatttattctctctttctctataaggatgtgaggtctggaacagctgcagccattttgccaccatgggaaacctgggacatctgaactgactccatgaagcctgaagagaaagctaataagaaggcagagagaagaggaagagtcttggtctttggaaatatcttttggagctgctggatcaagtatcacttgaaggtagaactaaatctgcactttaaatttacatatccaataaaaagttctttatgttgtaaaaaaaaat

SEQ ID NO: 69308 - DNA, 537 bp, Homo sapiens
gggaatcaggtcgagttctacactctccttcttggtacacatcctcagaatgcaggaagtgcctgtgcttgctgtgagtctttgtggacagaggcaggatcatgctggctagaatctagtggacaagggcagcacattccccctgttcccaggtgggtccagagatgtcgcctgggagccagggcctggagttctgttactgtggctgagcttgcacccaagctacaagatgacatcctactcttccctcacctttctacaagtagaggagtctcttctcatggccaccattgtcccaggatgtgaggtctggaacagctgcagccattttgccaccatgggaaacctgggacatctgaactgactccatgaagcctgaagagaaagctaataagaaggcagagagaagaggaagagtcttggtctttggaaatatcttttggagctgctggatcaagtatcacttgaaggtagaactaaatctgcactttaaatttacatatccaataaaaagttctttatgttgtaaaaaaaaat

SEQ ID NO: 69309 - DNA, 2794 bp, Homo sapiens
  misc_feature (1416)..(1416): n is a, c, g, or t
  misc_feature (1421)..(1421): n is a, c, g, or t
  misc_feature (1423)..(1424): n is a, c, g, or t
  misc_feature (2794)..(2794): n is a, c, g, or t
gctgggatatttaaaaagcatgatccttgcccatattcaaaacctactaggggagcccaaaaaataaagagactgtgaagatacagtatgaaattgctgcagtagagatagccacactcttgtggaagcatagtggagggtacctaagccagagagaggaagggcaggaggaactttctgcaggaagcaatgttgtatagggaaagggaaatgagactgagctgaccaggccatgctttctagcacgaggagggttgcaatgggtagcaaaagagataggtgttttatgaggaggaagcagtgtcccaaaggtgaagggtccagagggaacttggtgcatttagagaatcttatgtacagacctctggataagcgtcaaggatgggcgaggtgatattgtgatattgcagcagtgggctggagccaggtgggagagggctaagccctcccaatgtgcacatgtcagcctgtgggcagtggggagccatggaagaattctgatgaggtgacatctgtgtttttgaaaggtcattctagctcggtgtgggaagtaggtgggcatgcagcaagaccagatataagaaaaccacttaggaaatcagtatattaatttaggtgagaaggcccagagcctagattgaggtagtagcagtgagatggacagttggagattcacaggagtgctgtaactgaagattcgcagaagtgctgtgactgctcgagcaacatgccagggacactcttgctttagggcctacttcgctcaaaaaggccctctttagggccttgctttagatatgaacgtttgtgtctccccagaatttatatattgaaatcctaactcctaaagtgatggtattaggaggtggggcctttgggaggggcttagtaccttaacaagaacaacaacaacctagagacaccctcaggctcccccaacttttctaacacttgcacgtgaggttacagtgagaagacggccatctattaggaagcatgccctcaccagataccgaatctgccagcatcttgatcttggacttcccagcctccagaactgtgagaaataaatttttgttgttttgaagctacccagccaatggcattttgttatagcagcccaaatggattaagacaggccctctataccagctattgccttgacccaaagtgatttgtccccagatatctgtgtgagtccctccctcacctcaagtcttggctccagtgccatcttctcattgaagcatatcctgaccaccatgtttaacactgcacactccacctccccaccaacacacacgtcgattcttatcacccttttcatgctctatttttccctgtctcgtttattcactttctaatatactctgtaaatttaattattcttatgttcatgatccttctcccctgctngaatntnngctccatgagggcaggagtgtttttgttttactttgtccactcttatatcccaagctctagaataatgccaggaacataatagccactcagctaacgcttgttaaataactggatgggtgatggaattgaagatgaaagaagaggcatggatgatgccaaattttcttccagcttgggcagatgaatggggaggggagggacataatttatcacaacagggactaagcaagaggaacaagaagtggggaaggtgatgagttctgcttgaaacatttgtcaggcaataagatcgagagtctgaagatagaaatgggagaccagaggaatagcaagaaagatttggggtggtagagagtaggggctgactaaggaccatgaaaaggtgttctgagcggtctgagggcccagccacatacagtcaaccattatgaatatgtactggctggtggcagggcttctctccagcagaaaacaacagtgaggttagagaaggcacatgatttgattagatgttgaagatttacaaggcgagcagaggaaagacaaaggaggtagtatgctgaagatgaaaacagtatcttcaagtttatcctgcctaaggaaggagggatatcataaatgggataaatggcagggatgtaacagagaaactgagggaatggagattaggatgaggccaaacagcgtgtgttctgagagtcagggtgagtgttgaagggatggaaagaggcaggcaattatctttccttcatcagacaacagatttttactggacacagtattagggttctccagagaaacagaaccactaggatgtaagtatacatacatagaaaggtatgttttaaggaattggcccatgcagttatggaggctggcaagtccagaatctgcagtttgatcccaaaggctgcctgctggcagagttccctcctgcttgcgggaggtcagtcctttgttctactcaggccttcacctgattggatgaggcccacccacattaggaagagtaatctacttcactcaaaatctaccagtgtgaacagcagtctcatccaaaaacatcctcacagaaacatctggaataatgtttgatcacatatctgggcactgtgatctagctgagtagacacattaaccatcccttagcccagtagggtgactactgtgtagttaacaacagtatattgtatatttcaaaatagctagaggagaagacttgaaatgttctcaacacagagaaatgataaatgtttgaggtgatggatattctaaacttgattgttacaaattctatacatgtatcaaaatatcacacgtaccataagtatgcacaaatattatgtatcaataaacaaaatggacattn

SEQ ID NO: 69310 - DNA, 358 bp, Homo sapiens
catcactaaaataataataccttcctcacacgatgggcgtaagtaccaaatgagagaacgaatttactgtgtcgcaactagcaatcatctggtaaacactctttccctcccctgccttccctagtctctcaccacctcgctgttcccaccttcagcacttgcccaggcttcagcacttcccttgtgcaatggtaatacaagtcaagaattctagaatgccagagtcagaaaggtcttccgaggccaagcatggtggctcatgcccataatctcagcactttgggaggccaaggcaggaggaccccttcaggccaggagtttgagaccagcctggtgaacatagtaagaccatatctct

SEQ ID NO: 69311 - DNA, 270 bp, Homo sapiens
aaatgttggggtaataatacctacctcttagggctagtagaaccttcaggtgaaaaacaatttgagtacctacaaaatgccagtgtcaggcattggtaatagcaaatgactaagacccagccctattctcaaggaacaaaattctagaactaggatattctagttattctgaaattttcttaagcaaactttgataatggctgcctaggtcaaaattcaggggcttcagttaggacacagtgggggaaaagtgctgggattgattagtga

SEQ ID NO: 69312 - DNA, 2317 bp, Homo sapiens
  misc_feature (1)..(2): n is a, c, g, or t
  misc_feature (7)..(8): n is a, c, g, or t
nncaganngcctccacagatatcaaaagaaacctgaagagcctacaaaaaaaaaaagagataaagacaaaattcaagaaaacacacacatacataattgtggtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtgggggtggtggcagccagcctcctggtctgaactcagagcagcagccaccacaaccccctcctccaccaccgaccctgcccccatcttcacccaccaatcctggaggtggagtgcctgccaagaagcccaaaggtgggcccaatgcttctagctcctcagccaccatcagcaagcagatcttcccctggatgaaagagtctcgacagaactccaagcagaagaacagctgtgccactgcaggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacctgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtagcggccgccgccagcccgaactcgcggcaaaattacctctcttgctgtagtggtggggtagagggtggggcccgcggggcagttcgggaacccccttccccgctcttgccctgccgccgcctcccgggtctcaggcctccagcggcggaggcgcaggcgaccgggcctcccctccatgggcgtcctttgggtgactcgccataaatcagccgcaaggatccttccctgtaaatttgacagtgccacatactgcggaccaagggactccaatctggtaatggtgtcccaaaggtaagtctgagacccatcggcggcgcgccctgcagagggaccagagcttggagagtcttgggcctggcccgcgtctagcttagtttcagagaccttaatttatattctccttcctgtgccgtaaggattgcatcggactaaactatctgtatttattatttgaagcgagtcatttcgttccctgattatttatccttgtctgaatgtatttatgtgtatatttgtagatttatccagccgagcttaggaattcgcttccaggccgtgggggccacatttcacctccttagtccccctggtctgaactagttgagagagtagttttgaacagtcgtaaccgtggctggtgtttgtagttgacataaaggattaagaccgcaaattgtccttcatgggtagagtcaggaagcccggtggcgtggcacaacacactttggtcatttctcaaaaaccacagtcctcaccacagtttattgatttcaaattgtctggtactattggaacaaatatttagaataaaaaaatttcccagtcagaactgta

SEQ ID NO: 69313 - DNA, 2248 bp, Homo sapiens
ggcacgaggcacacacaattatgtatgtgtgtgtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtgggggtggtggcagccagcctcctggtctgaactcagagcagcagccaccacaaccccctcctccaccaccgaccctgcccccatcttcacccaccaatcctggaggtggagtgcctgccaagaagcccaaaggtgggcccaatgcttctagctcctcagccaccatcagcaagcagatcttcccctggatgaaagagtctcgacagaactccaagcagaagaacagctgtgccactgcaggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacctgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtagcggccgccgccagcccgaactcgcggcaaaattacctctcttgctgtagtggtggggtagagggtggggcccgcggggcagttcgggaacccccttccccgctcttgccctgccgccgcctcccgggtctcaggcctccagcggcggaggcgcaggcgaccgggcctcccctccatgggcgtcctttgggtgactcgccataaatcagccgcaaggatccttccctgtaaatttgacagtgccacatactgcggaccaagggactccaatctggtaatggtgtcccaaaggtaagtctgagacccatcggcggcgcgccctgcagagggaccagagcttggagagtcttgggcctggcccgcgtctagcttagtttcagagaccttaatttatattctccttcctgtgccgtaaggattgcatcggactaaactatctgtatttattatttgaagcgagtcatttcgttccctgattatttatccttgtctgaatgtatttatgtgtatatttgtagatttatccagccgagcttaggaattcgcttccaggccgtgggggccacatttcacctccttagtccccctggtctgaactagttgagagagtagttttgaacagtcgtaaccgtggctggtgtttgtagttgacataaaggattaagaccgcaaattgtccttcatgggtagagtcaggaagcccggtggcgtggcacaacacactttggtcatttctcaaaaaccacagtcctcaccacagtttattgatttcaaattgtctggtactattggaacaaatatttagaataaaaaaatttcccagtcagaactgta

SEQ ID NO: 69314 - DNA, 506 bp, Homo sapiens
agtttgaggctgcaatgagctgtgattgtgccactgcacaccagcttgggtgacagagcgagaccctgtcttgaaaaaagaaatcaaatgggtcaaagtcccaaatctttaatattgcatgatattactcatataaaatatttggaataggaaaattcacagagacaagaaagtaggttagagtttactgaggatgggatggggggcagtggggagtaattgcttactgtgcacattttctgtttaaggggacataaaactttggaaatgatagtagacatgggtacacattgtgaatgtcattaatgccactgaattttacatctgaaatggttaaaagtggtgtatgttatgttacatatattttaccacaataaaaaaataaaaatttggctgggcgcagtggcttacaccttaatcccagcactttgggaggctgagacaggcagatcatttgaggtcaggagcttgagaccagcctggccaacatggtgaaatgccatctc

SEQ ID NO: 69315 - DNA, 1298 bp, Homo sapiens
  misc_feature (44)..(44): n is a, c, g, or t
  misc_feature (47)..(47): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (62)..(62): n is a, c, g, or t
  misc_feature (88)..(88): n is a, c, g, or t
  misc_feature (97)..(99): n is a, c, g, or t
  misc_feature (115)..(115): n is a, c, g, or t
tgcggacacccgatcggcatagcgcactacagcccagaactccnggnccangcnatnctccngcctcagcctcccgagtagctgggantacaggcgnnngccaccgcgcccggcnagtattttcccttttgccatgtaatgcaacctactcgtgggtgcccaggattgagattggatgtctttgggaaccattactcggcccatcacatctgagtatgttgaagtcaccgaggatcaaggagacagcactgctggagagggcgatagtgaaccaggaactacaagagtcaggactgagaggaacggcctggggcccacagggaatggctgcaatgaggggagtggggcctgaatctgatgacagctttgggggcttaggaaggaaggaggcagaaaggtctgagaaccacagtgaggagtgaggatgccaccccacctctgggccaagggtacaaggtccctgtgcaaactcccccatgtgggaggactttggaagggaccacatcctctggcagacacagacatcgctggagctgtgaggtccaggaacatcctgagacaggatgtggaggttttgctgatcatgggctgagaattccaaggggcacagcgggaagacttctggatttgggaatggggtatggggagacaaaataggggtgtgcagagccttgtggggatgtgaatgcagggtgtttgggggacccagtgtgactgacacaaacagggaaaaggcatgatgagctcagtcctggtggactcaaggcagatgatggtgctgaggctgtgggagacgagggaggaggctcaggggtggctttcacctgggctctgtccatggaggtgaggacagtgagatagttgggcctcagtgctgtgtggaccctttcttgtctccctgatgactggatggagggcctggaggaagaggggtcttagaggattcactcatgtccctgggggagggggactcactccaggtctcaggtctgcactgacacatttgtttgtggcttggggctgcctgctataaactattgggggttcgtccattttggagttataacctaaggcagaaactcagatggttcaaatgtcctcttcatgaagcaatgttatcagcgtataatttagattgtcttgcaagagtctcatttgttgtttttctaaatgcctgccaatattgtttgaaaatctacaaatgtgataaatgtatcttcaaagttaactggttgcaggttgtttaaccttatatgtacagtttcacatatgtataaaaacagtagtttgggcctctt

SEQ ID NO: 69316 - DNA, 1434 bp, Homo sapiens
  misc_feature (44)..(44): n is a, c, g, or t
  misc_feature (47)..(47): n is a, c, g, or t
  misc_feature (51)..(51): n is a, c, g, or t
  misc_feature (54)..(54): n is a, c, g, or t
  misc_feature (57)..(57): n is a, c, g, or t
  misc_feature (62)..(62): n is a, c, g, or t
  misc_feature (88)..(88): n is a, c, g, or t
  misc_feature (97)..(99): n is a, c, g, or t
  misc_feature (115)..(115): n is a, c, g, or t
tgcggacacccgatcggcatagcgcactacagcccagaactccnggnccangcnatnctccngcctcagcctcccgagtagctgggantacaggcgnnngccaccgcgcccggcnagttttttttgtatttttagtagagacggggtttcaccgtgttagccaggatggtctcggtctcctgacctcgtgatccgcccgcctcggcctcccaaagtgctgggattacaggcgtgagccaccgcgcccggccagtattttcccttttgccatgtaatgcaacctactcgtgggtgcccaggattgagattggatgtctttgggaaccattactcggcccatcacatctgagtatgttgaagtcaccgaggatcaaggagacagcactgctggagagggcgatagtgaaccaggaactacaagagtcaggactgagaggaacggcctggggcccacagggaatggctgcaatgaggggagtggggcctgaatctgatgacagctttgggggcttaggaaggaaggaggcagaaaggtctgagaaccacagtgaggagtgaggatgccaccccacctctgggccaagggtacaaggtccctgtgcaaactcccccatgtgggaggactttggaagggaccacatcctctggcagacacagacatcgctggagctgtgaggtccaggaacatcctgagacaggatgtggaggttttgctgatcatgggctgagaattccaaggggcacagcgggaagacttctggatttgggaatggggtatggggagacaaaataggggtgtgcagagccttgtggggatgtgaatgcagggtgtttgggggacccagtgtgactgacacaaacagggaaaaggcatgatgagctcagtcctggtggactcaaggcagatgatggtgctgaggctgtgggagacgagggaggaggctcaggggtggctttcacctgggctctgtccatggaggtgaggacagtgagatagttgggcctcagtgctgtgtggaccctttcttgtctccctgatgactggatggagggcctggaggaagaggggtcttagaggattcactcatgtccctgggggagggggactcactccaggtctcaggtctgcactgacacatttgtttgtggcttggggctgcctgctataaactattgggggttcgtccattttggagttataacctaaggcagaaactcagatggttcaaatgtcctcttcatgaagcaatgttatcagcgtataatttagattgtcttgcaagagtctcatttgttgtttttctaaatgcctgccaatattgtttgaaaatctacaaatgtgataaatgtatcttcaaagttaactggttgcaggttgtttaaccttatatgtacagtttcacatatgtataaaaacagtagtttgggcctctt

SEQ ID NO: 69317 - DNA, 420 bp, Homo sapiens
ctcaggggtggctttcacctgggctctgtccatggaggtgaggacagtgagatagttgggcctcagtgctgtgtggaccctttcttgtctccctgatgactggatggagggcctggaggaagaggggtcttagaggattcactcatgtccctgggggagggggactcactccaggtctcaggtctgcactgacacatttgtttgtggcttggggctgcctgctataaactattgggggttcgtccattttggagttataacctaaggcagaaactcagatggttcaaatgtcctcttcatgaagcaatgttatcagcgtataatttagattgtcttgcaagagtctcatttgttgtttttctaaatgcctgccaatattgtttgaaaatctacaaatgtgataaatgtatcttcaaagtt

SEQ ID NO: 69318 - DNA, 388 bp, Homo sapiens
tgcttggaacctctgacctcccccttctgcggtgtctcctctgccttcctcctctgcagcatctgactccagccagagcagcttctctgcttttaatggcttgtgagatttgatcgggcccacacagatagtccaaaataatcttgcaattttaaggtccttaatcttcatcacatcagtattttcccttttgccatgtaatgcaacctactcgtgggtgcccaggattgagattggatgtctttgggaaccattactcggcccatcacatctgagtatgttgaagtcaccgaggatcaaggagacagcactgctggagagggcgatagtgaaccaggaactacaagagtcaggactgagaggaacggcctggggcccacagggaatg

SEQ ID NO: 69319 - DNA, 394 bp, Homo sapiens
gctcaccatctgggcttctgggaggatgggaaatcatttgtgtcagagtggctccaagattgttcagaactggcatacagaggattatcagagagagaaattttgcagtctcttggggctgtctttgaagaaggtgtttataacacattttgctgactgcttccataaatcccaagagcactgataatttttcatcagaaaacaagaagtgaaaatgaagcaatttggctgtgagaacatccttgaatttctactggtcgcttctaattgtaacttggctataactacatttttatcctttgcgttagagtatgaagaaaaacacatccttaagctttagaacagagcaatgtctaaaaacatcctgaagttcagagggcaaggagaattctct

SEQ ID NO: 69320 - DNA, 920 bp, Homo sapiens
gtcgaccactgtaacctctgctgcctgggttcaagccattctcctgcctcagcctcccaagtagctgggattacaggtgcctgccgtcgcgtctggctaagtttagtatttttagtagagacgaggtttcaccatgttggccaggctgatctcgaactcctgacctcatgatccacccaccttggcctcccaaaatgctgggattataggcgtgacatctgtgcccggacatatacatgacttttaaaatttgaatttatttctccataaataggatgcttatactattatttatctagtattgatttgtatttttatatcttataccttatggcttatcacttgctttagtacctctgttatattcttgaaagtatcaactttactcaaaatagtataatttaaagccatttctcaaggaaaatattaaatataattaaatttaattataatatttaataattacatattatatttaaagtattataattaagagtttcatataaaacgtccttttatatcacataaaaatggatgtcctattgaaaggagaaaaattctcttgtcccccttgtagggcatgcgatggggtgtggcttggactcgcttcttcggtgccctgctcctcaaaacccctaggggtggctgggctccgtagcttatgcctgtaatcccagcactttgggaggctgagctgggcagatcgcttgaggtcaggagctcgagaccagcctggccaagatggtgaaaccctgtctctactataaataccagaattagctgggcgtggtggcacacgcctgtatcccagctactcaggaagctgatgcaggagaattgcctgaacctgggaggtggaggttgcagtgagctgagatcacaccactgcactccagccttggtcgacgcggccgcgaatg

SEQ ID NO: 69321 - DNA, 412 bp, Homo sapiens
aacttattaaatatttgttaaatgaatgaattaaatcccatttgactgctaaggaaattgaaactcaaagagatcaagtgattgatttaaggctccactttccagtagggactcacatctgatttttcccattccagactgactctgatataatatcttacatactatttgttactctttctccaagatcttagaaaggtcttttgattctctaagaaaagataataggacaatgcaaatgcgtggatacaccatcaaaggggtggctgagggctgtctacctctttgtatagttctttcctaggttcctgactccgctaaaaactcatatccttaaagatatgactatttagatacattccttgttggagataagaacacaagttcattgctgaatcatggtgtatatata

SEQ ID NO: 69322 - DNA, 347 bp, Homo sapiens
aaaaaagtagaggggaaggcaaaaaaacgtgaaattcacagctcgcggttaaatgccaagttctctaccgagagcatttcttgtctcgtttcttctaacgttcattgtggatgtgcgagaggtggttcgcgccctagcaggctcttgggtccacagggcagtggcagtcaagacgtgtaaggcgcactcagaaagtagtacttcatattgctcgtgctcttcgttttttcttttttctcttttttttttttttttgagacagagtttcgctcttgtcgcccagtctggagtgcaatggcgcgatctcggctcactgcaacttctgcctccttctgcctccgggttca

SEQ ID NO: 69323 - DNA, 558 bp, Homo sapiens
aattttggaggttggggtgcaatctttagaatatgcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattatctggtttccagttttaaacattaactgtcaccttttattcttaaacttgaaagtacagaaatcattaaattattaagttgtacaataaagggattggtttctt

SEQ ID NO: 69324 - DNA, 843 bp, Homo sapiens
ccggctccacccccaagccaggcgaggcaggttccgaggttggaacacctggcgagtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggtgagtataagggactagaaatagaatattatcattaatgttgctgaatattttaaaagtacatagggctttgttttgtgaggctaaagcagtgatatccaatagaaatatgaagccacgtatgtaattttaaattttctagtagaatacatagaaaaggtaaaaagaaataaggcaaattaatttcataatgtgtgtcatttagctcaataaatgtaaactatcgctgggtgcagggtccatgcctgtaattccagcactttgggaggccaaggcaggaggattgcttgaggccaggagttcaagaccatcctgggaaacatagcaagaccctgtctctacaaaaaagatacaaaaatacccaggcatggtgatgtaagtcctagctacttatgaggctgaagcagaaagattgcagcactatactctagcataggcgacagagtgagaccttgtctc

SEQ ID NO: 69325 - DNA, 773 bp, Homo sapiens
tggatgaagcccaccctcattatgaagggtaatcacctttactcagtctactgatttaaatgttaacaacatctaaaaaataccttcacaacaacatctagactggtatttaatcaaacagttggatatcatagcctagccaagttgacacataaaattgaccatcacaatagctaagaaattaagaatttcttatctgtttgtcttaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccataggtgagtattaatttctgttcaggtataaagcataatgaaatatatttattttcatggccataagattatcatatttctaaggagactaataggagaagttaatcttcttaatgttatattaagaaaacataactgttggataaaagtttaaataatagatgtttttacattctagcctatgctgttataatttttatagtgataatgtgttattagggcaagtatatattcaggaccagcaatttccttatccttctgtaataaacctaaacctaactcatatttgaaaaaaatatcaaagcattcagccttccttgaataagactttctaatctctactgttcagcactgataaaggcacttgcaagatgaaactactacttgtaacacatacatatttcaaatgcat

SEQ ID NO: 69326 - DNA, 434 bp, Homo sapiens
ccaaacaaaagcacgattccaatgaaaaatccagttccaagaattagagtctccaaaggatgtgcatattcagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaattacaaccccacgatcacaagaagattcccacccctgcctcccatgcctggtcccaagacagtgagacagtctggaaagtgatgtcagaatagcttccaataaagcagcctcattctgaggcctgagtgatcgtggggtagtaa

SEQ ID NO: 69327 - DNA, 2242 bp, Homo sapiens
ccggctccacccccaagccaggcgaggcaggttccgaggttggaacacctggcgagtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattatctggtttccagttttaaacattaactgtcaccttttattcttaaacttgaaagtacagaaatcattaaattattaagttgtacaataaagggattggtttctt

SEQ ID NO: 69328 - DNA, 2138 bp, Homo sapiens
ccggctccacccccaagccaggcgaggcaggttccgaggttggaacacctggcgagtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgatta

SEQ ID NO: 69329 - DNA, 1125 bp, Homo sapiens
ccggctccacccccaagccaggcgaggcaggttccgaggttggaacacctggcgagtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctcttttcagtataatgcctataatgaaaagaggaagaagtttgagaaaaagactgaataaatatctcacgtttatctttcaggaaggtttacgt

SEQ ID NO: 69330 - DNA, 826 bp, Homo sapiens
ccggctccacccccaagccaggcgaggcaggttccgaggttggaacacctggcgagtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggtatgtgagagttatatttaattctttctgttagaggcaaaatgtctattttaattgcctgagcatttttctaaaattgttggtgacgtttttattttcttttcctttggcatgattattaagaacaatacacacacatacaaacaagccatttctacacattgtt

SEQ ID NO: 69331 - DNA, 2373 bp, Homo sapiens
  misc_feature (2354)..(2354): n is a, c, g, or t
ccggctccacccccaagccaggcgaggcaggttccgaggttggaacacctggcgagtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattaaaacaaaaaaaaaaaaaaaaaaaaaaaaaaaaaaaaaaaaaaaaaaaaaaaaaaaaaaaaaaaaaaaaaaaaaaactcgctcgggccgaattgggcacgagccacccaccacctttggcacagcccctttgtttttacaccaataccaagaattaagggggaagccttggcagttttcacgtttaaaccagactcctttgccggaacccaacccgncaccctgctggcctccgtc

SEQ ID NO: 69332 - DNA, 2424 bp, Homo sapiens
ccggctccacccccaagccaggcgaggcaggttccgaggttggaacacctggcgagtcctcggtgtcggtggccggcagtcatctcgcggccgttcaggtgagggggttggaggagtggctcatgagcgaggaagggggagcaggcgggctcccacccggtgctccgtgagatcgaggggagcgggttctgggtgcggatgcacgcgctgggcgggacgctggcagtggtacccgagacggggcggaaggagactggagtgaaggtgggcctaggctaagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattatctggtttccagttttaaacattaactgtcaccttttattcttaaacttgaaagtacagaaatcattaaattattaagttgtacaataaagggattggtttctt

SEQ ID NO: 69333 - DNA, 1956 bp, Homo sapiens
ccggctccacccccaagccaggcgaggcaggttccgaggttggaacacctggcgagtcctcggtgtcggtggccggcagtcatctcgcggccgttcaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattatctggtttccagttttaaacattaactgtcaccttttattcttaaacttgaaagtacagaaatcattaaattattaagttgtacaataaagggattggtttctt

SEQ ID NO: 69334 - DNA, 1074 bp, Homo sapiens
ccggctccacccccaagccaggcgaggcaggttccgaggttggaacacctggcgagtcctcggtgtcggtggccggcagtcatctcgcggccgttcagaattataaggctgtctgcagagatttgaaaaatggcaacaaatgaaagtgtcagcatctttagttcagcatccttggctgtggaatatgtagattcacttttacctgagaatcctctgcaagaaccatttaaaaatgcttggaactatatgttgaataattatacaaagttccagattgcaacatggggatcccttatagttcatgaagccctttatttcttattctgtttacctggatttttatttcaatttataccttatatgaaaaaatacaaaattcaaaaggataagccagagacatgggaaaaccaatggaagtgtttcaaagttcttctctttaatcacttctgtatccagctgcctttgatttgtggaacctattattttacagagtatttcaatattccttatgattgggaaagaatgccaagatggtattttcttttggcaagatgctttggttgtgcagtcattgaagatacttggcactattttctgcatagactcttacaccacaaaagaatatacaagtatattcataaagttcatcatgagtttcaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaccactatggacatcaatagtttctaataaacgaatggtcacccatgcccaaagaagaattaca

SEQ ID NO: 69335 - DNA, 1791 bp, Homo sapiens
tggatgaagcccaccctcattatgaagggtaatcacctttactcagtctactgatttaaatgttaacaacatctaaaaaataccttcacaacaacatctagactggtatttaatcaaacagttggatatcatagcctagccaagttgacacataaaattgaccatcacaatagctaagaaattaagaatttcttatctgtttgtcttaggctccatttggaatggaagctgaatatgcacatcctttggagactctaattcttggaactggatttttcattggaatcgtgcttttgtgtgatcatgtaattcttctttgggcatgggtgaccattcgtttattagaaactattgatgtccatagtggttatgatattcctctcaaccctttaaatctgatccctttctatgctggttctcggcatcatgatttccaccacatgaacttcattggaaactatgcttcaacatttacatggtgggatcgaatttttggaacagactctcagtataatgcctataatgaaaagaggaagaagtttgagaaaaagactgaataaatatctcacgtaaaccttcctgaaagataaacgttttcctgaattcagaaactagtagctaacattgcttctggagagcagaaataagcatgtcttctggctactaagtgataaaaagaacattaacaacctttaattaccttcctagtgggaactttttctactttacctacaagttctatatatgtagaaatgaataaatatatatttaagtacagttttcatgaggaagttttaaaagaccatgttcctaagcttccaagaaggttttggatactagaagtattaatctatggcttttctcccagtaaaaccataggcctgaagttcacattgggtctttaaatcttttagatatatactggtcatttcagaaaattcttcatagtggtattggccttatatttaactttttttttattttttttttgagacaaagccacactctgtctccttggctggagtgtggtggcacagtctcagctcactgcaacctctgcctcccagttcaagcaattcttctgcctcagcctcccaagtagctgggattacaggcacccgccaccacgcccagctaatttttgtatttttgtagagatggggtttcacgatgttggccaggctggtctcaaacttctgacctcaagtgatctgcccaccttggcctcccaaagtgctgggattacaggtgtaagccactgcgcccggcctttttaactttaaacatgttttagaattcacctaaagatcaaaatatcatggattgaacctcatcaattgatagcagtgagtgactgaagcttccaaatcaagaaaagccggcaccaagaacttccattctaatctagagctgaccagtttgagctgattctctctttgaagagtccttcttgattgcagtgcagtactggcatttctgaatggatgtaagtggagtattttagtctaaaggcttttcaaattacttgaatttttttaaaaattgaggagctttatttctatttacccttccatttttgtatatcaaatttccattgtcattaaaaactgtatcttgaaactttgtgaactgacttgctgtatttgcactttgagctcttgaaataaatgtgatttttgtgtgattatctggtttccagttttaaacattaactgtcaccttttattcttaaacttgaaagtacagaaatcattaaattattaagttgtacaataaagggattggtttctt

SEQ ID NO: 69336 - DNA, 3124 bp, Homo sapiens
gtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtcaaaaa

SEQ ID NO: 69337 - DNA, 3228 bp, Homo sapiens
agcggactgattggaagcatcggtttaagggcactggcagaatcctttgcttgttctccgcggcagccactgctgtgtcagtacagtgtggaatggaagtcttagttggtagtctgttatggaaacgctctttactgttattgtagtaccgtggtgacaacatgccattgaaatggaaaacgagctctcctgctatctggaaattcccagttcctgtgcttaaaacatccaggtcaactccactttctccagcatacatatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtcaaaaa

SEQ ID NO: 69338 - DNA, 3107 bp, Homo sapiens
cattatccaacttttagaggtgatggatcatctgcatagaggggaattggttgctgcaatacttcgtaaccggagacggaggcaattgtcattaaaacaagccgatttcaaggatatattcaaaaaatcaacttcaggatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtcaaaaa

SEQ ID NO: 69339 - DNA, 5336 bp, Homo sapiens
cttggaattactcagataatcattcctttaagcatagattgatataattgtggcttggggtttgcagagaagtgttacctccttgcaatgttgaagaacagtgctcttcacattcaatcaataaacttaataaaggggagatagatgggaatattgaatctgctaagaaggttaacatggcatgtactgttaccaaagcagaaattagtagggagtgttttgaatgttaaaaagtcaaaagatactgataaaacatcatgaaaaagataattttagtccaggcttcttcagcttttgaagtaattaattaaaaaggcaagcatattatgttggcaagaaagggctgcattttcactttttgctttctgtttttaagagcaagagacaaatgacaaagtaaataagttgttacttgtagtttactcaaaaaagcaatttccgggatatgtcattgtggcaatgtgaattcagctttactcctatcccttttacatctgcagtttcataagaatgataattgatggtcatttaagcactgcataataaagaaatgtctttggaatgatctacagaaagaagattctgtattcattcagaggacatatattaagtctttcgtgctaggctctgtgcagggaatacagaaactaataaaacagtctgcttgaatatcctattaatataatctggatgaatagacattttctggttagggataacagtcaccatcaatcaatttctgacttttccaattgattctgtaattttaaacgtctgtccacaaaagttgtttaaaattgtgtgtgtgtgctatatatcataaatataacttaattctctttaaagctatctctgaaactctggtggaaggctatatccagtttcttttatgctttttaaaatcttaagttattctcttctttattaaatatctatcagaattgaattaaacatggttatatattattaattcatttttggttatactatggctctaatatcattaagaagaattgatgtcatccttaaggccagaatttttgctaattattgcaagatttaaaaccacttagttggtgtcataattcaaaaagcagaatctttagtatggtctttttcttgttaaaactgatcaacttggggttttaggtatgacaggaaaaaaaggtgaaacctttctgatattggatagctcagttagacagttagaaaagcaaataattcaaaattgaggaaattacagaaaaaatgaagagttccagcacttgaaaatctgctctccttcttttttcctaatgtctattttagcagtctttttagcagtctgtatcatgaatgcagaaccaaattcatgagccatgggctccccactcttaggcaggtgatccagagattattttagcaatgtatacctatggagaaacacaagatctcttctaaggaatgatgaaaggttattaataatggcacatttttagtataacctgagatttttaaactatcaaatgtattgtcatattctctttgcatctaagtgacctactgactaaggttctcctattcttacttatgccccttgaaaatactattgctgcaatacatgcaaatacagaattgcctgtatttatatttttagtattcatttctttgaaaagatggaaatgtgactagattgtagctattaaacaatcccaaactggtaagtgagagatactgctagaaaaagaaattatatcatgtgaaaaattttgttcagttggggttgattagaactactactaataacagaagataaagtaatgcattaatatataacaattaatcttttacttttattaatgggggtttggagtgggaatcagactagacctagattcaaaccctgggccaaccactttaataagtggtttctgacccttctttagtctgtgtataaaattattggcaagtacctgctatataatgactattcaataaatggtagctatcatttttatcttttcaaaattaggtgttccaaattaattttaactatatgcagcataatttgatggcattgctatctaaatagtaacatatcaacagtaattactgtggcctttaaaaactctgtgactataattttgaaccaccttttaagttgatttctcagttatcatctgtatattctgtacttggaaaccattttacaaatatacatttcttctaagataaagagtggtacaagcgtataatatagtgaaacaatattcaccatattgcatggtcatatgattgcaatagtgactgattatttttctaaataatctcattgtaaattgtacaagttttaatttccccttctttcttatgtaaaaaaactttcagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtcaaaaa

SEQ ID NO: 69340 - DNA, 1655 bp, Homo sapiens
tatgaaaacattcggtaggtcgagctcgtggtaatcggcacaggatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtcaaaaa

SEQ ID NO: 69341 - DNA, 319 bp, Homo sapiens
agtgagactctgtctcaaaaaaattaaaaaaaaaaaaagagagagacaaaaattattttagaaattaaaaataaatataaagtacccaagagaaggaaagactgactgaaaataaaatatgtatcattgaacaaagccataaaaacagccaagagaacaaaacaaaatgaagtagagtagtaagcatcaggaaaatggccaggaatggtggtttatgcctgtacacccagaactttgggaggctgaggcaggaggattgctggagaataggagtttaagaccagcctgggaaacataatgagaccccatctctgccaaa

SEQ ID NO: 69342 - DNA, 324 bp, Homo sapiens
tcattccccctcccaggctgttttccatccagattagactctgggtggcatttttgacttcacgatcccaattctaactaagcaccaagtcccactaattcaaatgccagaatttttctcaagtccgttttttcctttccaccttcactccagtgaccctggttcagatttttctttctcttgttctactactggtcttccagtggatactcctgccctctcaaatctttcacctcaattccttctttatatgcatgtgatgggaacaatctctgatataagattcttcagtggttccctgataacatccaatcttttaaaata

SEQ ID NO: 69343 - DNA, 894 bp, Homo sapiens
tctgtgtgtatatatagttactgattgtgctactctgtaggagaaatacaaaggacaaaagaatgtattcctgctatcctacttttctgctgtcacactaaaattgtgtgggaggcttaagtgagttgaaagactggattatggtagttgagggaatgggttttttgttagtttaccattttttaaaatacttagctagaaagcattctgaattattgaataaattacgtcatttattttttatttgacagtttgaagataaattattttctctgttgcctctatttcaccacctacaaatggtccattatgttctggacatgtttaagagcctctgaggaatggagctgcaaacacagacacaaatgttcatctttgccacactgaactatattttaatgtttactgaagccatcaagcttttcttgaattcatgcaggagtattttaattacattaaaacatggcattattttaaaagtaatctatgtttttaatttaaaggctacttatgcttaccatggtagagagtacaactaaggaagttttcttaacttgcctccctctttcttttcctacccctacctaaatcataggctattaaaatgaaatctgggccgggcgtggtatctcacgcctgtaatctcagcactttgggaggccgaggcaggaggatcacctgaggtcaggagtttgagaccagcctgaccaatgtggagaaaccccatctctactaaaaatacaaaaattagcctggcgagttggtgcatgcctgtaatcccagctactcgggaggctgaggcaggacaatcgcttgaacctgggaggtggagattgtgctgtgcaccattgcactccagcctgggtgacaagagtaagactccgtctcaaaaaa

SEQ ID NO: 69344 - DNA, 1632 bp, Homo sapiens
ttaagtttatatttgcatttccaagcgtttctaaaaatcactaatgccatctatacttttagtatgaaacagcagactatagaaagcacagggaagaataggctaaatacattctttgaagaaccagaggcatataaccacatcattatgtcattcctaatacatggctagattttctaatgataaaattgactgtgtcccaatgcttatttgattctaagcttttttattctgtttctgagatattttaatagctttgcaaaatatgctgaccagtttttggaaaataatggtttttatagcaagcaaagactttatggcacattttcaaaatagcactcatacatacttacattttgacagaaatgtgaattctcacattgatgagatatttttttcccacctgccctaccctttaaaaaaggtcacctttctaatgtgtagtagattcatttacgcctttccctttgagtcataccatgtttggagaactgtgtgaattgtaggtagagaaattaactagggaagccagaagcttgaactaaagttttaaatttgtaggcagatgagaacttttatactatggttgctttgggcgattctaattttgtaatagcatcatgatcaccaaaattaattcaaacattttagtacatctttaatctgtcttatttaccaaagttctaatctgtttaagaacaggatgccaagagcatctttcattttatagaatgatatgctcacctttataagtgtcacctaaaagcttgagggtaaaaaagaagcagcccatatatctaaactacaggatgtcttgaacaagattcacagaaagaaagaaaaaaaagcagttctttccaggaaggtggtaaggaagagcatgcatatttcttgttttaaccaaataccttttttatgtaaatgtctctattaaaccccaggtcctacaccaggaaatagggtgataaccaggaaaataccaagctttaacccagttggcagttccttgtggcatacatttggttagacttgggtttttcttggaaccaaaggaaaataagcatgttgagttcctcgttcaacagacatgacattgaagtaatagaatattttttaagtaaaatagttttcactttcaaagcctatgacataaggacatttgtgcttattaattgttaatttttttttatggtacattgtataaactgagtagcattgaactgcattttagaagtatgtcatcagaaacaaatcacattatggaaaggatatacaaatgccaagtgatatgactcttttggcatggtggtagcatggtccattcagctttcagaatctttcggaggctctagtttggtgcctagtactagttatttttgttagaacaatctctcaaaatttagataattttccagttgtatgtctgtcacttttaactctaaagcgtaagaatcatggtaaccctctcctccccccgccgtccccgcggctccatcctccgccgccgcccgagcagctgcggggccgccaccgccgccgccgccgttgcaggctgagtcatcactagagagtaggaagggcagcagcagcagagaatccaaaccctaaagctgatatcacgaagtaccattt

SEQ ID NO: 69345 - DNA, 2531 bp, Homo sapiens
ttaagtttatatttgcatttccaagcgtttctaaaaatcactaatgccatctatacttttagtatgaaacagcagactatagaaagcacagggaagaataggctaaatacattctttgaagaaccagaggcatataaccacatcattatgtcattcctaatacatggctagattttctaatgataaaattgactgtgtcccaatgcttatttgattctaagcttttttattctgtttctgagatattttaatagctttgcaaaatatgctgaccagtttttggaaaataatggtttttatagcaagcaaagactttatggcacattttcaaaatagcactcatacatacttacattttgacagaaatgtgaattctcacattgatgagatatttttttcccacctgccctaccctttaaaaaaggtcacctttctaatgtgtagtagattcatttacgcctttccctttgagtcataccatgtttggagaactgtgtgaattgtaggtagagaaattaactagggaagccagaagcttgaactaaagttttaaatttgtaggcagatgagaacttttatactatggttgctttgggcgattctaattttgtaatagcatcatgatcaccaaaattaattcaaacattttagtacatctttaatctgtcttatttaccaaagttctaatctgtttaagaacaggatgccaagagcatctttcattttatagaatgatatgctcacctttataagtgtcacctaaaagcttgagggtaaaaaagaagcagcccatatatctaaactacaggatgtcttgaacaagattcacagaaagaaagaaaaaaaagcagttctttccaggaaggtggtaaggaagagcatgcatatttcttgttttaaccaaataccttttttatgtaaatgtctctattaaaccccaggtcctacaccaggaaatagggtgataaccaggaaaataccaagctttaacccagttggcagttccttgtggcatacatttggttagacttgggtttttcttggaaccaaaggaaaataagcatgttgagttcctcgttcaacagacatgacattgaagtaatagaatattttttaagtaaaatagttttcactttcaaagcctatgacataaggacatttgtgcttattaattgttaatttttttttatggtacattgtataaactgagtagcattgaactgcattttagaagtatgtcatcagaaacaaatcacattatggaaaggatatacaaatgccaagtgatatgactcttttggcatggtggtagcatggtccattcagctttcagaatctttcggaggctctagtttggtgcctagtactagttatttttgttagaacaatctctcaaaatttagataattttccagttgtatgtctgtcacttttaactctaaagcgtaagaatcatggtaaccctctcagaagtggtcctttcttgctcatttcagtttcgtattaatttcaaatcactgatgtattgtctttcaagctatcaattgtcatatgtaccaatttaatttagtttgtagttatctgaagtcacaaaattggttcagcattgatgtcaaacaatggctttgcttcttaccaaacagacttagtatcctgctgcttgtttcaatcttgatgcagtaagtgatgcagtatctgggtctgtatttacttagaaactgtactgtcctttctctgtgcttaacttgctaaaaatatattcccttacctgtgaaattcctgagcggtgctctgccaacttttcaaggggagggatttggatggctgtgttactgcacactggatctggaattgttcagggttatgagtgacaaatttcttaaacaccagcagcactgagatgtgcactatgggcattcgtacagttgttgtccaaatgcaaacaactttttcatcttggagaagctgagatacagagttcaatagaactacttggaatattttgagaaggttgaatgtttcatctttggctttgttgtctctggagtggggaagtatggagggcttttttttttttttaaaagagagggtgtatgtactttttctctttataagggccagggggttggtcaaattcaccatcgattaatttatatctctgtggggatttttttcaactttttaacaaggcccaactaattgcccatgggacaatctacttttccccccaatttatcgttttgagtagggaaaggttcattttttttcattccccggctttaagttaaaaaattcatttttttgcatacatttgagtcattctgggacctataaagggtttttgtaactatctaattctaagggttgcaaagcaaagcacatgactgtaaaaccaagcaaggtgttttagtaactttttccctgaatacttggtagtttccattgatactattccaaaacaaattctgctgttttaggttgtatatttactttgcttttgttctaagaaaaagccaaggactaaatcaact

SEQ ID NO: 69346 - DNA, 4042 bp, Homo sapiens
agttctggaaagtcattgacaggggattaacctagaacatcaattataaacaggcagcaggcctcaggcccagacttgggtgttacaggaacagtgtggcctctctggaactctgcagaccaactgccgtgatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgcc

SEQ ID NO: 69347 - DNA, 3949 bp, Homo sapiens
gggttcttacccatttaaagtttgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgcc

SEQ ID NO: 69348 - DNA, 4336 bp, Homo sapiens
agttctggaaagtcattgacaggggattaacctagaacatcaattataaacaggcagcaggcctcaggcccagacttgggtgttacaggaacagtgtggcctctctggaactctgcagaccaactgccgtgatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgccctcccatgctggatcctgtgcagcccccagcctgcaccactcagcagtggggggctgcctttcaagctccccatgggtgggcaggtcagttgtgtcgttctcctcagagggtagtgagaatgaccatcgtggccctgttttaagtcactattgggtgcctactgtgtatactccccaaacaggactagtagtactgaacttgcttgaggggtggggcctgttctaagtatttaacacctattaacacagggaattaaccttcatcctcttatggacacagaaatcaagtcacag

SEQ ID NO: 69349 - DNA, 462 bp, Homo sapiens
agttctggaaagtcattgacaggggattaacctagaacatcaattataaacaggcagcaggcctcaggcccagacttgggtgttacaggaacagtgtggcctctctggaactctgcagaccaactgccgtggtaagagaaccgactttcagaggcctctaggcactttgtcctgggtaggggtgcccacacatcctggccattgttgctcttccctctggaacttggcagctttctagcagttagaagagcagagggtagaaggatgggaacagtccttagagaacaggaatctaggggagggttggactagatcatttctcaagagctgtggggactgttctggtcaggcatgggcaagctgaggggcaggaggtaggcaaaccctacttgacctgagaacagatttgttgttgttttgtttttgtttttgagcctgggtgatagagtgagactccatctc

SEQ ID NO: 69350 - DNA, 4204 bp, Homo sapiens
agctgttctctgtcagtggaggcagcagcggtagaggcggcggcgaggactggcgacggcgaggagctgccttctagtctcacctgtggacactttgccaaaggagtcgggcctgacggtggaagatgggaaatggccaaaagaataaaccatttcctcttacttaccgaatgaaaagcttgcttcatcttggcgttcaagactctctaatatgattccacctgttgggctctttcttccatttgcctccgcagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgcc

SEQ ID NO: 69351 - DNA, 3947 bp, Homo sapiens
agctgttctctgtcagtggaggcagcagcggtagaggcggcggcgaggactggcgacggcgaggagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgcc

SEQ ID NO: 69352 - DNA, 4020 bp, Homo sapiens
  misc_feature (3978)..(3978): n is a, c, g, or t
  misc_feature (3998)..(3998): n is a, c, g, or t
  misc_feature (4002)..(4002): n is a, c, g, or t
  misc_feature (4004)..(4004): n is a, c, g, or t
agctgttctctgtcagtggaggcagcagcggtagaggcggcggcgaggactggcgacggcgaggagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgttgtcacanttatcacacctcggagaggnttancntcaataagtcgtttcc

SEQ ID NO: 69353 - DNA, 4098 bp, Homo sapiens
agctgttctctgtcagtggaggcagcagcggtagaggcggcggcgaggactggcgacggcgaggagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggtattgtctcccccagggccagccaggcggtggggcttggctgggcccaggatgtcatgtcccctctgccctgtgtcttcaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgcc

SEQ ID NO: 69354 - DNA, 1180 bp, Homo sapiens
aaggtgtacccggagtacgggattcgtcgaccggcgtcaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgcc

SEQ ID NO: 69355 - DNA, 1298 bp, Homo sapiens
agagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaagggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgcc

SEQ ID NO: 69356 - DNA, 3257 bp, Homo sapiens
agctgttctctgtcagtggaggcagcagcggtagaggcggcggcgaggactggcgacggcgaggagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaactcctctgcgatcttgggtccctgcaggaagaggcgagtattcaggctatccagggggccaaagatggcagtgaagtccttgaagtggg

SEQ ID NO: 69357 - DNA, 131 bp, Homo sapiens
tcctggagggatgtgtccctgtccctgagcccagccactctcactgctgccctcgactcagcctctgcccagcccaccctgacccactgcccgctttctccccaggccatgtcatggtaaacggtccaacc

SEQ ID NO: 69358 - DNA, 4016 bp, Homo sapiens
agctgttctctgtcagtggaggcagcagcggtagaggcggcggcgaggactggcgacggcgaggagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgcc

SEQ ID NO: 69359 - DNA, 4520 bp, Homo sapiens
agctgttctctgtcagtggaggcagcagcggtagaggcggcggcgaggactggcgacggcgaggagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgccaaaaaaaaaaaaaaaaaaaaaaaaaaaaaaaaaaaaaaaaaaaataaaaaaaaaaaaaaaaaaaaaaacaaaaaaaaaaggggggggggggcgacagaaaaaatcaccccccaggggggcgcgcccaactacggaggcgacaccccgcttttggggggcacagagggggcgcccacaagaggaggaggcggcaataataatagcgaggcgacgagcggaggagcggcggcagatcataataaaacgcagcagtaggtagagtaggcgagaacaccacggcgcgagcgcaccagggcgggcaaccactgcctggtgggaaggccggcgcccccaccatcactcctcgggggggggcggcgagacacaccaatagtgcggcggcagacaacactcccgccgcagtcagagagtaattatagacaacgcgcccccggcggggcgggcccaataaacacacgacatctcaacgagcacgttagtataccgaggggggacaaccacacg

SEQ ID NO: 69360 - DNA, 2023 bp, Homo sapiens
  misc_feature (1798)..(1798): n is a, c, g, or t
tatacaaaatataagtaaataggaaaaagtaactatagtaacagttgctattggaattcctctttggatttattagagaaagtaccctaatatctgccttgggtatagatagtgaaagcccaagcattttgggtctggttagaactaaactgtagcaaacaagggaggagtttttcagggactctggaatgggagagaacactgggataactgagaggagccaggagttggtgaagtctttgcattaggggatgtgacacttcacaggcacccctctcccctatgtttttactaaaaactaccaagaacttgatgtgtaaggatttcttatagaggccagtaaaaaggttaagtcatgcaacaggaagctttgcagaaaaacagtctatacccaaggatgcaggagcacagaagtagagaacataaggaggaattcttgagaatttgctggattatcggggacacttcgggctgacacagggagtggggctgggattataggcagagtgtaatcagaccactgaggggcagagagtctctaacatctaagttacatacttatattttaaatttttgtgattttagtttttgcttgctccattagagtagaaaataagtatttgttgaataagttagaaaaatgaatgaatgaatgaattgctttcaggactatgccacagaatgttagagtaggaaaggaccttagggatctattagttaaacctgttgagcaattagttcaatgttgttaggtattgatctcactccaaagataataaccattagcagcaataacaacagtcactgctatgagtgcctaccatgaatcagacagtttacatttataatctctatttttttaaacctttcaagaaaagtgtcattattgctacttttcaaatatgttgtccaaagtttctcaattagtaacccaaatctgcctgtttctaagccggggtgtgcccacctttttggctatgctttttctcaggtcattccaaagacagaccatttaaccactggatctggggcaacaaaggtggatcaatcgtgaatccttcactaaaaagcttgctttgtaatagatgaaacagtttaatttttaaatctagtgttataagggtttaagtagtagcacactgtcaaacttctgttggaatgaaaagaataagaactgacgaccacaaaaaagcaattctgcttaaaccagtgtctctcacccttggcactattaaattatcagtacaggcggtccgtgacttctgatggttcaacctacgatttttcaactctacaacagtgcaaaaacaaaaacaaaaaacaaaacaacaacaacaaaaaaagtgttgtcagtttgttcatcgacttatgatggagttacatcctgataaaatagtggttagttgaaaacattaatattttttattttactttaagttctgggatatatgtacagaacatgcaggtatgatgcatagatatacatgtgccatggtggtttgctgcacctgtcaacctgtcatctaggttttaagccccacatgcattaggtatttgtcctaatgctctccctccccttgcccccaacccgccgacaggccccagtttgtgatgttcccctccctgtgtccatgggttctcataaacattaatattttcaacttacaatgggtttatcgagatgtaatcccatcataagtcaaggaccctctgcactgaatatacttcattgtggagggctgtcttgtgcatcaaaggagggttagcagcatccctggcttctacccattaggtgctntggcataccttcttccactgttgtgacaaccaaagtgtctccagacattgctagatcgggcaaaattgtgcccagttgagaatcactggcttaaaaggaaaaaggccattgcatggatgtgcaataacacctttagccatttcctaatgatgtcatttaatcagttaggatttttgttttgtttttagtattttgctgttacaaataaagctgcaatgaacattg

SEQ ID NO: 69361 - DNA, 853 bp, Homo sapiens
tgagacagagtctcgctctgtggcccaggctagactgcagtggcatgatctcggctcactgcaacctccacctccggggttctagcaattctcctgcctcagcctcctgagtagctgggattataggcgcatgccacacctggctttttgtattttagtggagatggggtttcactgtgttgctcaggctggtcttgatctcctgagctcagacaatccccccgccttggcctcccaaagtgctaggattataggcgagagctgctgtgtgcttcttaagtgaggtaagtaacttccatagaaaatttccatcagttcattcatgaaagaacaaagaacctggcaaaacttaaaaaaacgtttccaagaatcagataaaagaggacaaaccttagggagaagaaggcagctgctcatttccagcaggggaagtagctgcatagagtacaaggactggtaggcctgttggctgttcctgtttaaggagacaagatgggcatggaacagggaccaccccctcctctgggagaagctgttacccccttcacttttcctcctctgtcattacccacaatcactctccttctttgcgctatggtaggtgtttacccatcataggaatgggcatttgaactttgaaactgaatgtggtgattacacttcatgctgaagcttttcacatgagtgctttcataagcattaagtaaaattttataatgactgcagtccaaggacattttccctggtttttggccagtctaaatattgtaagagagagagaagaaaagtgtacggaatataattgtctctaagctaagaaatgtggatgttcaaataaaacatacgtacagaa

SEQ ID NO: 69362 - DNA, 537 bp, Homo sapiens
gacatcagaacacatctcagcggtggtgactagtcctcggatttcctgccatggtgctgccattcccaccgcccgtgccctctgcctaggctgttcctgctgcaccgaacgcctcctcctgccaccgccctccctcctttctttagaagcccctgccagcacctgagctctctgctgattgctgttcctcccagtctgtggaagctttgcccatatgctttccttaaaagggttctgggcagggcaggcgcccccatttctcagggatcccctccaggacaacgccttttccttgtgtcttcagctctccttaccagatatctatatatttgtatatattcagtttcaccaacaatgcatcaagtacttttttttttttaagtaaagaaccgcagtcatcgaactggagtcccattgattccctccccctcgcctccccaaatctggcacctgcccaaggtatcctcagaaccatttggggtgtcctttggcattggataatagaaataaaattttacctctttctaccataaattg

SEQ ID NO: 69363 - DNA, 457 bp, Homo sapiens
atagttacaccaagagggaaggaaacaatgaaattgaagagatttgaatgtcacgcagcgctgttataattaaatgcaagcttccataccataactcattaaaagtagtggtgactttgaaaaatttggcaacaatttaaactgcaaagttgaaagagaaatgtgtgtaagaaaattagacaccggtgcagtggctcacgccttgtaatcccagcattttgggaggccgaggcaggtggatcacttgaggtcaggagtttgagaccagccttgccaacatggtgaaaccctgtctctagtgaaaatactaaaattagccgggcatggcgcgcatctgtaatcccagctactcgggaggcggaggcaggagaatcacttgaaccctgaggtggaggttgcagtgaggcgagattatgccactgcactccagcctgggcacagagcgagtctccatctc

SEQ ID NO: 69364 - DNA, 410 bp, Homo sapiens
catcccaggattcttgacacataaacaaattggtgcaatgtgctataagagatgtgtaggggaataagagtaccaagaaagaagccatgaggttatgggtgtttgtggggctgaggatacaagaagtgtttcctgtaggagataatgataatatgtgtttagtctactatgtattcttaaccttgttatctttgtgctggaatgacccctttgtaattatgcaatgaactacttagctctgatgctatttactgcactaaaatttacttggtctaacattaatatagccaatctagcaattttttgatgagtgctggaatgatatatcattttccatcaagatttctgatagtagcatatagatgggtcttatctttttgtctaatttattaatctctgtcttttaactg

SEQ ID NO: 69365 - DNA, 523 bp, Homo sapiens
  misc_feature (455)..(455): n is a, c, g, or t
  misc_feature (484)..(484): n is a, c, g, or t
catcccaggattcttgacacataaacaaattggtgcaatgtgctataagagatgtgtaggggaataagagtaccaagaaagaagccatgaggttatgggtgtttgtggggctgaggatacaagaagtgtttcctgtaggagataatgataatatgtgtttagtctactatgtattcttaatctatatttgtaaaacaatggtccacataatgatatctgacttgtacaaaatatcttttagggacagtagtttttatgctggcaaattaaaattatgcaagaactctgggaccccttaagttttcctgggtcttacttactttgtaaattttagctctacatagtgtaatatatgttttatctgaatgttgagacacactaaggaacaacacacttctttttgcactccagcctgggtgacagagcaagactgtcaaaacaaaacaaaacaaaanaaaaacatttcaaatgtaagaaccaaganccagtactcatccctcaaatctgctgcttcccctgcttc

SEQ ID NO: 69366 - DNA, 442 bp, Homo sapiens
gattgattcaataaagagatctactaggcagttgagctccaggtcctgcatttttcctgacatactctgtatttctctctgtccagctccagcttctgaaatgccctctcagcttagcacggcctgcttatggcgagaaccatgtattcaatggctcctccttatttctgcaagtcttcaaattctccttttggtaattctctgcatggaattaactcttgcaaatccatgtctcacttttgtgtgacctattttgtcttatgctacacattgtccatgttttagcagtagattggaagcttttatgtgcatagccttcccaagaggaaagtaaaaggttggtgctagatggtgcaccttcgataaatgtcagaacagcaaaaaaagggctttagaaatatttccttctttgcacattcccattcaagaatggcttatacag

SEQ ID NO: 69367 - DNA, 298 bp, Homo sapiens
ccgcagtaataactgttataggcaagatccattggtagatgcaatatcactaggcaaaaatttgaagaggaacaggacattcgcatggtctcaaagtatctccaccaagatatttattaaatacagcaaaaaaatataactaactttacaacagagaaattaagcagacaccaacataaccaagccatcaaggttatcaccatcactcatatacctagaaatccctaatgactcgtacaaaagactcctagatttgataaacaaattcagttaaactctcagcttacaaaatcaacgt

SEQ ID NO: 69368 - DNA, 765 bp, Homo sapiens
aaataacatcttgtcacctttgtggcactctactggttagcagtcacaggtctaggccatctcaaggggcagggagtacataaggctgtgaacagcaggtggggatcacagtgaccacctgggagtctatctgccacacctcccagtgcatccaaattctgttgtgcagagggcaagtgaggtctagcataccccccaagaaagcagccatcttctaccatccacccaccagtttgtaaactccagtcaggggtgtaattgaagtgatgcctggtttgggattgagttttcctggagattctggtcctgtaatgagttttttccagctgggattccagttggtgatggacagcatcaagctgtcccttgctcctggccccagaccccacaaggtgcttttcaggctggtctcgaactcctaacctcaagtgagccacccacttcggcctcccaaagtgctgggattgtgggcatgagccaccacacccagccatggtacacacttctaataaagcttcctctacatctaagctttctgatttccaccctccaagtacttaaaactgactcgatgtgaagtaatgctatgtgaaatcgacataaaaaagttactgctcccgaagatcctttaatgcaatctccttacccttaattcaatgggcaagagaatcttcaattttcattttctttctcctctctacagtttcttaatcagagtggctatttccataacaataaaaactgcttcttacagaatcctcaggc

SEQ ID NO: 69369 - DNA, 1207 bp, Homo sapiens
aaataacatcttgtcacctttgtggcactctactggttagcagtcacaggtctaggccatctcaaggggcagggagtacataaggctgtgaacagcaggtggggatcacagtgaccacctgggagtctatctgccacacctcccagtgcatccaaattctgttgtgcagagggcaagtgaggtctagcataccccccaagaaagcagccatcttctaccatccacccaccagtttgtaaactccagtcaggggtgtaattgaagtgatgcctggtttgggattgagttttcctggagattctggtcctgtaatgagttttttccagctgggattccagttggtgatggacagcatcaagctgtcccttgctcctggccccagaccccacaaggtgcttttcaggctagattcctgagggctgtgtcatcagctgtgccacctcctcctccctaccatgatgaactgttttgggtacttacctgactccagagaaaggtcattaaggtcatcacaatgcaatgtgcatctgctagtgcctcatccgagtgacgctcaggtgaaggaacagcctgtggccacacgtctaaccaggggataggcctagatcctaaggccaggtctgtctccacaatccaagtgctgatcttcaatggtacatactttttttttttttccttttgagacagtcttgctctgttgcccaggctagagtacagtggcatgatctcagctcactgcaacctccacttcctggaggcaattctcatgcctcagcttctcaagtagctgggattacaggcgtgcgccaccatgcctggctaattgttgtatttttagtagacggggttatctgcacccctttactacttagggagatgctctgtcggtaggtttggtggaagacggaaagcaaggggccaggctctctagaacggcctgtatcatgagacgccacaagagaattaagccccacacaaagtgattcaagcaactactttcacatcaaccaaaggatgatgaaaagactgtactatcctagagaacacaggagagaaggtaccgattgccttagacaacaaggttgcatttcctcactttggccagcctcacaccccagccctgaactttcaatctggacacttggtcagtggtgagagaagtggccgtgagtctagctgtggcaccctgaagagtttaacagccacg

SEQ ID NO: 69370 - DNA, 425 bp, Homo sapiens
gccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggcct

SEQ ID NO: 69371 - DNA, 460 bp, Homo sapiens
ctcgtgatgctgtctcagtgcctctgattaaaacccacatctgttagtaaatgaggggtgagatctctgttgattaccagcatgtcagctctcagccttattgacacattcgatcaaagagcatttattttgtaggcacagacaagataatttgaaaagatgaattttcttcttcacaggggtgtgtttctgggttctagtgaggggactattctggacagaattagggccaggaccccggggactttgtccagtttgctagtagtggggcaggtgtggacgttgtctgggttgcccagttttgcccgtctctgaatggggccattgtctaagatggttctagagggcaggggcctcgtgggcgagcaggcttgtccttctaaggaagtgcatgggttgggtagcactttgtcgggatctgcaccccgtgtgtgctggactacgtgctctgagccaagct

SEQ ID NO: 69372 - DNA, 350 bp, Homo sapiens
gaagagcaatgtttgcttttgttttcaatcctagaaaagttcaaaaaaagcttttattctatataaactctaaagtgtatatattttaaacgtgttacttcttttttttaattttgcattggcatctgtagaaatttttgtcagtttaaacaacaatgcttgaaagtcactttgacttttcaagctgccagattgccttatcattgtctttgagagattagggatgcttttttagaaggttgccttttatgtaaataaaactgaagttttgttgttccattgtagtatttcattttaatctggttgttttcttgtggagataatatataacaggatccaaaaatagttca

SEQ ID NO: 69373 - DNA, 349 bp, Homo sapiens
agaatatgggaaatttagttgtagaagatttaagaggaagaggatcacgatagtacatgaagactgtttaaaaaactgtcttgtagaagttatgtcaccttttttgttgtcattccagaggacagaactgggacaagtgtggatcagtggttgaaaatgacaggaaattagattttagcttaacataaagaagaacagttgggttgttcagaacaaatggaatgggctatgtagattttttgacactaaacagaaattgaatgagtggtaaggattctaaaggggatattgaccattcagcgggtgattgacttgaatttttttttttttttttttttaattttttgag

SEQ ID NO: 69374 - DNA, 429 bp, Homo sapiens
tatagtctaattaaaaataaaaatataaagaccttaataaatactaataatggaggtcaaagggcacatagtgaagtgcagttgagaaatgacgtgacctgtgtatttgtcttattcctgctatatcgcataaacaggagaatgaattgaaaattgtaattaagatttattccattttgttaagattaaaaatgagcagtcaaataattctttctctgagagaagagtgtatggtaggtccattgagggtgtctgttgtatcttaaaatctattcgaaatgtttgggtgaattattgtctaaattgacagatgattgcttttgagctaacaaaatatttctgttagcatagctaaagaatatatgttaaggaatatatgctctttgtaagttttgattgagtagataagatgatacagacacatgaatc

SEQ ID NO: 69375 - DNA, 994 bp, Homo sapiens
atgattttgaggcagggaaaggtaggggattgttaaatataatctggtttgtctaggtgagtccaacagaacagaatattaaggtagttacagttaggaaggctcccaaataattgcaccaagtagatacaaatttggttactggatttgaggggccagattgcctaacttcttaggatctgtgatattgatacagaattagagcaaaatcacttaacttgcttgaggataaaataatgttgagaatggcgttggcatgaatgagctgctgacaagcttgctgttgttccattttgttccattttgtcccctttcagttggttactgtattttccctttctttgaaatgtagtcattcttaacccagtaaccttcctatacaatctgtacaggtacatgagcaatttcaaattttatttggattaagtgttttttatactgaggaactaactgtctttccattttatatctagcttttagtatcacagatctactttttggatttttttcctcccctttgattgcaaaatgaatggcaatatcatgcactttgttgggattcttttttagtagtatacaatgcattctctttgctatgagtaacccctgaagctggagatgggtcctaaataaaggattctaattgcagctttggttcttcatcatacctccttccccacatcagcacgtgcagaattgaaaagttcaaacctgactgccatttgaaaaagggacattgcaaatttgttttcattaactttgttatcaatacatgtagcctgtggtgttaaaaattttaaagggagaaagaggcaattagcatgaaatgttcaaatgaatggtttgtggtgcctttgaccatgcatatgttgttttgggaggtcagcttgttggctctgttgtaaggttttaaatggattatcctgtgaaagagattgggtatagtgtttctcaggtgtacagaagaaaaaagttattaaacctgaccattctg

SEQ ID NO: 69376 - DNA, 349 bp, Homo sapiens
catcaatgtttaggttatttgaatattgttcttgaatattgtttttgaatatctggactaactctggaggctgaggtgggaggattgcttgaagccaggagttcaactgcagcctgggcaacatagtgaaaccctccatctctaaaataataataataaacactcaaaaaagacacaaatatgatcagctcctcttgaaccctatttctccacagtatatacaaggaacacaactttgctgttaggtcttcataaaaaatatataattatgaaactatgaattaaaataacccctcaatgtgttttattttctatttaaaagcaatgcagccattacagactacttaca

SEQ ID NO: 69377 - DNA, 306 bp, Homo sapiens
ggatacaaagcagaataaggacagggagaagtcacatggacaaagttcagaggaagccaggtgcaagcttccaagagcctcttcctatggaatcacacaggacatgcttaatttctccaggatggaattgggacagcacatgtgaaatgctgtctatcaagaaagcttattagagactcggttcctaaggtttttagtgggaactggtcacatggaccccttcttgctatcatctgccaagattcccttctcccagaaggaaactagacttttagcataaagcacattatttgcacaatttaggca

SEQ ID NO: 69378 - DNA, 467 bp, Homo sapiens
ctggcttctctttatttgttgtttttaaaatcatactgctgtccttatgcatggtactccttggaacagataagcagccatacaagaagctctttgagagagagaaggtggactctgggggtcgtgccggttgtttggagttgttggactgttagcttgtggagtgggtgatgtttcatcttcaggattctgtgaggccaggcctgggatgcggggaggagctgactggatggctcctggtgatgcattcctgggccctcttctcatctctgaattcctagagtcccactttctccaaaggccctgcgggaatcagacgcatgcacttcttcagttctgtgtagttttaggttctcagtggaggcctttgggctcaacttgtagtaaatatttgttttctgtggctgtcagcaatctatagtcttgggtgtggtccctaaaagccagcttttgggcaatttttgaac

SEQ ID NO: 69379 - DNA, 851 bp, Homo sapiens
cactttgggaggctaagaatcacttgagactaggagttcaagatcagcctgggaaacatagtgagaccccgtctctacaaaaaatataaaaattagttaggtgtggtggcatgcacttgtagtcccagctactcaagaggctgaggcagaaggatcccttgagcccaggagtgcaaggctgcaatgagccaggatcccatgatcacacatctgtattccagcctgggcaatagagcaagtccccattactaaaaaacccaaaaggccaaaaaacaaaaaagttagagttcgaggaattaccaactgtagttttagccttggttcatgctctcttgcatatttatataatctctgacttgtaatggaccctgactggaatgtgatccctcaggaacttagtagcctgagtctttcagtagactacactgcccagaaccctggccattctcaaaatgagaacttgggaatgtttaagaagaaatcaaacatgtttcaggaaaaggaaatctatggagtattatagggacattcccatgggaatgtatcttcctccatggcatgtcttgagggtcctttcttgttaggagtttatcctgccagcccataaatggactatttattgtaagtgtagaaaatcacagagaagcagttttgcaccagccttattcctgtgccttgttttcctcttgctctttttttacctgtatatctaatttatattttcatatatattgtgtattgattgaagtcactttaaatccttcttgggaatgacacagtatataaataaggaagaaagaaaacatgccaagctgagcatgctgctccaaataaatatctgctttcctact

SEQ ID NO: 69380 - DNA, 811 bp, Homo sapiens
gttaaatattatctgcctaaaaaaaaaaatagttaagtctctcttacatgtgaaaaactagaggcattcccactaaggttcagtatggacaactgtatttagtgctaaatctatttaaaattgttcagtaagtgctaatcaaaacattctttaaaacaatataaaatgataaattttgaatgttgaaaaactaaatgatttatttaacccggtataactgactgataaacgattagaattaataatcttccaacagggcagcaagataatatacataaaccagtgctccccaccgttgacaattttttatctgtctcaccatgaaacatcttttcatgattaaaaactcccaaccaattaggtagagaaatgtacctaatcataataaaggccatatatgacaaggctgcaactaacatcatccttgacagtggatggaactaagctaaaagcttttcctctaaaatcagacacaagacaaggatgcccattcttaccacttctattcagcatagagggctagaagtcctagccagagcaattagtcaagagaaggaaacaaaagacatccatattggaaaggaagaagtgaaatttgtagatgacatggtcctgtatgtaaaaaaaaaaaccctaaagacgccaccaaaaaatgccaccaaaagaacagttagaactaatgcattcagtgaagttgtaggctacaaaatcagcatacaaaaatcactcatgtttctatacactaatattgaattaacagtgagtttctttaatgaaaatcttttaaaaatctcatttacaataacatcaa

SEQ ID NO: 69381 - DNA, 364 bp, Homo sapiens
cagtttatagacagaagacaggaggagtgaagctgtggacttcagctttgttgttgaaaaggggtactctgtgacagacctgggttcaactcttagcgctgttacttactagctacgtgatttggggcaaattacttggccactccaatcctgttcctgtaaaatggaggcaaaaagaataattcttacatcatagagtttttgtaaggattaaatgatagaatatttattaagcatttggttcagggcccagtacattataaagtgcttagccagtgttagctgttataaaattatcatcacagtcgattctcactgtgcatgcaattatccttctgatttcaactatgtgtgctggaacaaa

SEQ ID NO: 69382 - DNA, 999 bp, Homo sapiens
tgcttgatgaggaaaggattgctgcacgtcattgtgcctcggtgctttccatatcagcagctgttaccacctttccaaaaggtgttgccaagaaacaggagcagggtaagatgtttttctctaaccagacagaaatctgctgactttccagaagtctaattgaacttgaaggcagaggaaataatgtgacttgaatctaacttgaaagtcttggaggaatttggtgttacagtgtgcaggccaccttaacctggcaaattccattctatgcaattctgctttcgttctattaaatacgtacctttgtgagtcaaggatttcagcacttgttgccatagggaaaaagttgtaatgggttatcaaagatgaagtatatgttgctatgtcaaaagccaaagcacagtttcaactcatttaaactagatctcattgagatgtactactgaacagtcagaattttctaaattttttttccaggaaacagtcatttttctttcaaaagagaacggaggcataatcctttacaaatattgcttatgttcagtaaatcatcttccagtgcagtgaaacgaagtaaatggtgtatgcacttctgcgcatgtttctggaggaggaagtccatatctttagtcagaatctctatcgatttagctattgtggaggcagtaggttgctctggataaatctgagcaaaggaatgagaggaaatcagctcatttgaagaatatgggatgcgaagctttgacacgacaatggcgagtaatttagggattcaggttatcccccgcatctgagtaatctgaaggtaattttctagctagagcttctcaaaggtaggaaccttgtgttatcttttttgttcatactgtctgagcacagtgcaggagacataatagggactccaaaaatgttgagttaaattgaaatcactgtatgaatagtgaaagctggactgtagcaccaataataaatgctcttctgtcttatttgtatttaaca

SEQ ID NO: 69383 - DNA, 613 bp, Homo sapiens
ggcacacctgtagtctcagctactctggaggctgaggtggaaggatcgattgagctgggaggtcaaggctgtgcatgaaaaaaacaagaacaaaagcaaaacaacactatcttgatttgtcgcaccgcaggcagttttgcttgttttgaatttatataagtagaaccttttgtttctggcttcttttgctcaattttatgtttatgagattcaaccatgttgttgtatataacagagatgtattcctttttgttgctatatggtattccattatatgaatagactacaatccattaaccaggttttggcactgtggttgtttctatcttttggctattgtgaataatgctcctatgaacatgggtgtacaaatacttcttcaaagccgcttttccatttttttaaggcatatactcaaaattgctggctcatatggtaattctaggtttaatttttgaggaactgccatactgttctctatagcagctacaccagtttacattcttaccagcatgtagggtagcttgggttccagtttctccacattctcaccaatgcttgttattttctgttgtttttattttttaataataaccatcctaatgaatgtgaa

SEQ ID NO: 69384 - DNA, 477 bp, Homo sapiens
tattagcaccacatggactctcgtttacaaagattttgttgcctgagcagaaggtatttattagataatcatacattaattttctcatgagttaaaaccagccagaccttctgagccatgatagcaagtgccgtcacactgaggtgctgcaaaccctcacaaactgagaaccttactcctttagttaacatgggcagccttatccccagaaaatgtaaaacttcactgtgctttttcaagtatattcccaggattccttcacaggcctgtaaggcatgggatctcagtattggctgcatgacagaaatgcatggggaactttttgaagaccaaaatgccttggtctgacccccagagattctgtttatttggtctgggaggtgctgcctggatgttgggatttttaagagttgtgtggcccaagttgagaagcactgtcctaggggctcaggaattgcttggccaaccttcttgctt

SEQ ID NO: 69385 - DNA, 896 bp, Homo sapiens
agaaataatgcatctttttagaatgtacaatatccattttaatcaatggtaaatgattgaaatatttttatattaaattcaaaaagttacgtagaccagatagaaaggtcaatttatttttttgagacggagcctgggtgacagaaagactctctgaaaacaaataaaaaactaactaaggaataatgcaggctatgttgtatctaggagcggtagagagagtagtgtccaagtaagacccaacaaccagtgactgattgattggctaaaatcctcttcaagcaaggcttggccctaaagaaggttagcccttgggcaagcatgagggcatttcacagaggccactggcacagtgaggctccagtgtggctggagctggggatgagggcagacaggcaggagcagcttggactgttgaagactagagggaaacagaaggaagcaggaactctgtgaaaggccgccgtgccttaccagaccaggggagaggagagaggatggacattcacagtcctcactgctagcagtcggaactcacctgtagctcacttattactgacatgcaaatgaatctaaactgcctaaaatgttagcgaatccatctaaaatctggctttcaaatccttcatatgttcatttgcttagcaaaccttctataaaaatagaaaacacacatttccaaacagagtccacattaatgaggccttcgaaagactccagaaaaccaatgcaagagtctgcacatagccgaaagtttaaggaacagtttctctccctcattcctaatagcaagtgaccaaatgactacagattaaaatgagaattttcctcaccttctttcatgccatatgtacctcctggccctctaggcaatgatttcagaagggtctttgaac

SEQ ID NO: 69386 - DNA, 977 bp, Homo sapiens
acaactagggaatttagaaaatggaaattagtatgttcactatttaagacctatgcacagagcaaagtcttcagaaaacctagaggccgaagttcaaggttatccatctcaagtagcctagcaatatttgcaacatcccaatggccctgtccttttctttactgatggccgtgctggtgctcagctacaaatccatctgttctctgggctgtgatctgcctcagacccacagcctgggtaataggagggccttgatactcctggcacaaatgggaagaatctctcatttctcctgcctgaaggacagacatgatttcggattccccgaggaggagtttgatggccaccagttccagaaggctcaagccatctctgtcctccatgagatgatccagcagaccttcaatctcttcagcacagaggactcatctgctgcttgggaacagagcctcctagaaaaattttccactgaactttaccagcaactgaatgacctggaagcatgtgtgatacaggaggttggggtggaagagactcccctgatgaatgaggactccatcctggctgtgaggaaatacttccaaagaatcactctttatctaacagagaagaaatacagcccttgtgcctgggaggttgtcagagcagaaatcatgagatccctctcgttttcaacaaacttgcaaaaaagattaaggaggaaggattgaaacctggttcaacatggaaatgatcctgattgactaatacattatctcacactttcatgagttcttccatttcaaagactcacttctataaccaccacgagttgaatcaaaattttcaaatgttttcagcagtgtgaagaagcttggtgtataccttgcaggcactagtcctttacagatgacaatgctgatgtctctgttcatctatttatttaaatatttatttatttttaaaatttaaattattttttatgtgatatcatgagt

SEQ ID NO: 69387 - DNA, 2045 bp, Homo sapiens
  misc_feature (431)..(431): n is a, c, g, or t
  misc_feature (435)..(435): n is a, c, g, or t
  misc_feature (441)..(441): n is a, c, g, or t
  misc_feature (691)..(691): n is a, c, g, or t
aaaaaatgattttcttctgttggcttggcatgatgagaaacggcttctgtgagggcgaggttcaaaaacaagacctttgtgagcaatgggaagggactgcctctttgactgcatttattacggaagctgaacggacagctcccagctgaaaaggcaacttcaccatcgacggttctcgccaggttaaatgtcagtagatgaaggcctcatcatcactcatacttggcttttctccttttctgctgcttcttctccctaattggaaatctttggactaagaatctgtaaaacaagtctttcaaactgccttcaagtatctcctctgtgtcacttggtaacaaaggtcgaagataacagatggagtcctcagtgtaacttgataaatgtttcccttcctcagccttttgtctgattggacatctggaaggagncagntgttgnctttgttacagtggttcaagaatgtcagaattgcagtcactacaattctcctggcttttctctcatggtccccaaatgactgctggagtttcagccatcatatcagtgatcaaggcagctggatccaggcagtaatccagacacttggaagtcccacccaaggacttctgctcttatctcattggtcatctttgtctgaaaggaaagctgtgaaatacagtattattaataagcacgttgctggctccantaatatagagtcttgttaacaacaaagaagaggagaatggagattgagcaaccaggaagcagtctcagccacaccatcatatggagaagtgcctgtttcccattctgcccgattttaagtttcctgaggcacccccagccatgcagaactctctggtgcctggcccacaggaagttttcactaaatattgaaataaactgaacttagattaaactttggtgtctaacttaggaaaaacaacaagagttctacaaaactatttcttcacaggctgttgtagcagggagaccctcaagggcgtctacaatatcaccacaactctcatagagctgcctgtgaaggatgacaagaaggaagtaggctgagacccaagttctgggtcaggggactaatgctgttgtcaccaagaagggaaagtctgaagccaggcctgcttagcagaggtctccgtatagtagggatctcactctttcaagatgtaggatctcaactggttagccagccctctgagtgaagctggtcagttggggctgtgacaacatagcacactcaaaggggcagacccttctcagctccaacagattggtgtcattggaaaaggtggacccagtgtaggcagactttcctagagagtccagaagtgactgtgcaagcccaaagcaatccaaacaaatatttgtggaccaccaagaacctctggtatgaagtaaataataaaggcattgaacaataataacctgtctgtatatccaccaatgggaccgatgggccacagtgtgacatctatcctattcatgtcataagggagatgaattctactgtgggacagtctgtgtgactgctcgtaggagattatccaattccttttgctctaatttcatggtcaccaaatttctgcttgctaactttgttttacaacaaactttagaaaggaggtgatctgaataagaggatatatgtttttcagtctctggaaaggggtatttctttgtattgagaagccagaactcttgagtgtgttgagccttgtagagattgaaccactctgggtcagctgacaaaataagattctggtgctgaaaagctgagtatgtgaccatgatattaacagtgacctaagtttgtgtggcccccttcgttctccagaaaccaaccagtcagccttcattttgtaaatgtagcagacaccattttgctagtgaatgaggttaaatctttagccttgtcattggttcggctttgtaatttaaaactctcttattttaccctctgattttaaatccccagattttcctttctgtgtcctttgccccctgaagtttccatctgtctagcaactaagcactgtttgggt

SEQ ID NO: 69388 - DNA, 850 bp, Homo sapiens
gccctcagagacagtggaaaggaaaatcttcccagcaggtggagctgtgggcaggacaccagttcatgacaccgcgtagcttgatctgaaatgcgtgcagatgtgtgggcagtggccaacagcctggttgtatggtcaaggtactgaaataaaaagaactggaagatgaggaacaaggagatctggataaaggccatgtgggtagaaattcgggagtgggcacagggtgaagatttctgtatcacttgttaacctccactggaaagtttcccaccaaagagacactgaacacaaagcaggcaaaatccgccagcctgcatcatcgataagtccacccagaattatcagcctgatggaccccacacatcatcgcatctgacgaggggacccactttacagtgaaggacgtcgagcgtgggcccatcgacaggatccaatggtcacatcacatatcaaaccacccaacgcgggtccatcccaatgaacgctgggccagccttttcaaggcacactgaagcacaagcttgccagacactctgaaaggatggtcatactccacaacacagtacacttatacatcagaggcctctagatggcagtgggatcccaaggaggaggacatgtgggcttaggcgcctagggctggaggcaagaaaagccctacttaatgatcaccaccaacagcccaggggaactttgtgcttcccattctgcaccagtggacactgcagggctgggggtctgaaatggggcacacacttagcaggaacaaggcaaagatcccactgaactgcaagttctggatgccaccacggtactttggactcatgttaccatggaatagaaaatg

SEQ ID NO: 69389 - DNA, 347 bp, Homo sapiens
ctggaggaaagtgacagaggtccggacccaggtttggtctaacttaggaacagtaatgagcagttcagggactgcaggccaatttattcgttgttgcaacaatgagcacctaccgtatattagatctgtaccgggtgagataaaatcaactgtctttacccagagaggacttgctgtcaggaaggggagctcctccccatgagtcctgaaggctagtgggatgctccctgcttcgctccagtggcctacctcagccagggttggtatggtgtctgaggggttggctgtggtggcccattgcccattccccatttcagttcaaaatgtgaagagcatttatagcatgt

SEQ ID NO: 69390 - DNA, 473 bp, Homo sapiens
gtttttccttagcaaaatgctgcagtgagtacccttgtacatagatgtttgtacatttgttctagaaaaatctacagtaaagattcttagattaagagattcccaggttattagaaaacttctctattaatttagatatatacttccaaattgcctgaccaaaaagttatgtcaatttaacttctatgaacagtatacaaacatgacaattttccatcacctacaccaactctgggtaatttcatcttttttacaagttgatggattgttttaatttatatttctctggttattaataaggttggccacctcttcatgtgttattattgatgatatttgtattgaattgtttgaattttcttgatttggaaaacctttttacatgtcatagatattaaatatttgttgtaaaactctccttccagtattttgtatatgtttggtcaagtagaataaactcttgtcctctgatt

SEQ ID NO: 69391 - DNA, 369 bp, Homo sapiens
agttataaatgaacatctgttgcctacttaataggtcattgagtagctgtgacccattcttaatttgtatgtaagcatattttttacatatttgtatctacttcattttcccttgaagcttgccaaattggtacacttcagtttgaactgatgtctcttatatgctgtaccaccttcttaaaaattgaattatctttccttccacctagattgttctcaaagcatttgtttttgctggactttccactcttgaccataagatggtagcattccctaagatattgcagcacagtctaattccactgttgtcatctacagttaaatcgcaaataaaaaataataataagcagcaactgattgctcaagttg

SEQ ID NO: 69392 - DNA, 498 bp, Homo sapiens
attttgagcactacaatggaggagatccagtcactcggctgcagagttcagacctcactaaggacttgcttttcttctgattttacttaaagattaatgtagggtgatggactttggatggagaatgcctggctgtcctgtcttcagctctatcttgcactgtggtcatcaacttttctcagatcaaaaataggcaggtacgggtagtgggcttacaacgtttgaccgcaactggtttttctaagtattctgtacatttttcagcagcaaaaccaaactgggtcttcagctttatccccatttcttgcaaaggaagagcctttatatgattgggcacattttggtttttccttactgagaattttagtcttcttttgtattgtttctataataatttgtaaacatatttatttgtacctactttttaaaacttttctggtgaaattcattgtactgcattttatttgtcaaaataaacattctcataatgctggttaa

SEQ ID NO: 69393 - DNA, 1819 bp, Homo sapiens
caatccatgagtccatactaatataaataaagtgacaaagtgggtgagaaggaccagtgcccctggatgaagaatctctgctcatgtgggaggaaggtgggggatcaaagctggagcacttgctgctgcaggtgagacccctgacacactctcaaattggtaggcaaaggtttaaagaacgggatatttgcttagcttaaaagcacctcccaaggggaaaacagtaacttcacagtggagagacctggcaggcaccaccctcagatcaaaatgaacctcagcagtaatgacacgtccacatcagcacccccaacaccactccctgaggaggacatgccagttctgggaacatcacactcatcgtgaaaaaacatcagacaaacccaaacggatgaaatgtgaggaaaatctgtagttggttttacgcggatgttaatctcttagttttgatcattgtgctgtagctgcataagaggttagctgggtgaagtgtatctggggaccctctatggcttttgcatcttttctctaagtctcctgtcatttcaaagtaaaaacaaaaaaagaagacaagggtagcggcttcaggtacagctggacccagcactcagtgctatctgggcttgtggctccaactcaactcctccatcagaactgtgagaaatgcattctttcagcttctaatcctgcaaaaagaactgcatggtcttcccccagaaatcctaagagtagctgctggtgtctcatgcatgcgagctgcatatgggcccccgttagtcaggaacccatgctgagaggtgctatgctttgaatgtttggctcctcccaaactcgtgttgaaacttaatagccattgtaacagtattaagagggcagggccttcaagagctggtcaggccatgagggccctgtcctcctgactgagtgaatgctgttattgtaggagtgggcttgtttggcctcctcttgctctctctacccctctctgagcccttgtgttgtgggatgacacagccagaaggcccttgccaggttccggtccctccaccttggacctcccagcctcccgaacgttgagccaatacatctctgctcattgtaaattacctagtcttgggcattgtgttacagcagccaaaaagcagcctacggcagtcaccgtgctaacacctgcagcagcctgcggcggtcaccgtgctaacacgtgcagcagcctgtgtggctcaggccagtcagcttcccctggaagcaagtgtgaggtcgtcgcctctggaagtgctagcggagggtgatctcccgggaggaaatcagagtggtgttctactagaaggccgatgactcctgggtaaagtgccaatgctcacctcccatctctgcaagctcagtccctcgtggaatttccccaggagcacaagggcaatctcgacagctcccacgttccccagtgcccgaccccaagccctggccccatgatcagataaatgccctaagtggggtggcatggacatttgcacacgtcccagactgctttatgttagaagctgagctggcatgccactagctggttttgatgtaaacaacaattttgtaaaaccctggactgaatgggtctgactaacggctggttctgtgaacttgagcctcagcgtcctgtgtcagaagagcacaaaccactttcccagagaggttatgaagacagaaatgaccctgtgacccctttgcaaagtatgaagaacggttcccactcatgcatggagctggatcttctcaagtgggaaacaggcgtggtaaataaatactgttgtttcaaaaaaaaaaa

SEQ ID NO: 69394 - DNA, 1451 bp, Homo sapiens
  misc_feature (3)..(3): n is a, c, g, or t
tangcaagcttggcacgaggcggatgaaatgtgaggaaaatctgtagttggttttacgcggatgttaatctcttagttttgatcattgtgctgtagctgcataagaggttagctgggtgaagtgtatctggggaccctctatggcttttgcatcttttctctaagtctcctgtcatttcaaagtaaaaacaaaaaaagaagacaagggtagcggcttcaggtacagctggacccagcactcagtgctatctgggcttgtggctccaactcaactcctccatcagaactgtgagaaatgcattctttcagcttctaatcctgcaaaaagaactgcatggtcttcccccagaaatcctaagagtagctgctggtgtctcatgcatgcgagctgcatatgggcccccgttagtcaggaacccatgctgagaggtgctatgctttgaatgtttggctcctcccaaactcgtgttgaaacttaatagccattgtaacagtattaagagggcagggccttcaagagctggtcaggccatgagggccctgtcctcctgactgagtgaatgctgttattgtaggagtgggcttgtttggcctcctcttgctctctctacccctctctgagcccttgtgttgtgggatgacacagccagaaggcccttgccaggttccggtccctccaccttggacctcccagcctcccgaacgttgagccaatacatctctgctcattgtaaattacctagtcttgggcattgtgttacagcagccaaaaagcagcctacggcagtcaccgtgctaacacctgcagcagcctgcggcggtcaccgtgctaacacgtgcagcagcctgtgtggctcaggccagtcagcttcccctggaagcaagtgtgaggtcgtcgcctctggaagtgctagcggagggtgatctcccgggaggaaatcagagtggtgttctactagaaggccgatgactcctgggtaaagtgccaatgctcacctcccatctctgcaagctcagtccctcgtggaatttccccaggagcacaagggcaatctcgacagctcccacgttccccagtgcccgaccccaagccctggccccatgatcagataaatgccctaagtggggtggcatggacatttgcacacgtcccagactgctttatgttagaagctgagctggcatgccactagctggttttgatgtaaacaacaattttgtaaaaccctggactgaatgggtctgactaacggctggttctgtgaacttgagcctcagcgtcctgtgtcagaagagcacaaaccactttcccagagaggttatgaagacagaaatgaccctgtgacccctttgcaaagtatgaagaacggttcccactcatgcatggagctggatcttctcaagtgggaaacaggcgtggtaaataaatactgttgtttcaaaaaaaaaaa

SEQ ID NO: 69395 - DNA, 577 bp, Homo sapiens
agaaaccatctgttctcaacagtcaacagcaggctggatggtgctgaacaaggtgaaatttaccaggattaaatgcagtagtgtgctgtagtgtgctggagtgatggttacattttcaggaattttgcaagcctgctgaaattaagttggtaacttaaaactggccatggtaggagtacttatgccatagaaattggcagctactagtcaggacatctctccccagaagctagttgttatgcaccagcaaaccagctaaatgtcaaatccttcaattccatccacaaaataagtggcacgactaattgcaggcagtataggtatgatgtacagagcctggattttagaatcagatagatctgagggaataatggtaagaggaatgcaacactgctggctgtcaagatgaaggaagggcccacaagccaaggaatgtgggtggcctttagaagcagaaaaggccgtgagccttgagaaaggaatgctcacaccttgattttagaacaagaacatccatgtcagacttcttgcctacagtactgtaatataataaatttgctttgttttaagccatcaa

SEQ ID NO: 69396 - DNA, 460 bp, Homo sapiens
atgccaccaggatcagagatgatctggccagctgagcccttccttaattctaacccataaaattgtgtgcgaaacaaaatggttgttttcaaccactaagttttggggtaggttttatgcagcagcagataatggaaatactgcttggttttgactttcaaaaaaatccatttgttttcaggcttgtctgcactccttctttaagaggtgctaagagactggacttagttctttgtccagataaatgtgtttttcccactgctagcttaggttttatttttttcacgtctgctaagtcagtagtccatttgcttttcagcttccaaaacttaattattctaattttccttattgttctcttccttgtggatttatgcattttatttgctcctttctgtaatttttgtggtatttggcaaacagtgaaggtaaatatacacattcaatctgccacatttaa

SEQ ID NO: 69397 - DNA, 384 bp, Homo sapiens
ggcaggagaatcgcttgaacccgggaggcagaagttgcagtgagccaagatcgtgccactgcactccatcctgggcgacagagcaagagtctgtctcaaaaataaaaaataaaaaaaaagtaggtcttttcatcattgtgttttctagcatgtagcactgtaacttccacctactagtaactgaaaacacgcatgtgggaacattgcacagatggatagatgcagagatgaaagaaggaaagctaaaatatttgccacgtgaaaaccatgcatcctgttcagaaactaattctgccttcacgccttccaggagcatgggaggggtgtcgtcctggcccttttgtggatgagggggaccacatggtatttctactgaagagttgt

SEQ ID NO: 69398 - DNA, 1362 bp, Homo sapiens
gggagggtgaggtgggcggatcaccagaggtcaagagttggagaccagcctggccaccatggtgaaaccctgtctctactaaaaatacaaaaattagccgggcatggtggcagacacctgtaatcccagctacatgggaggctgaggcaggagaattgcttgaacacaggaggcggaggttgcagtgagccgagatcatgccattgcactccagcctggcgatagagtgagactacatctcaacaaacaaacaaacaaacaaacaaacaaaaaaacaagacagaatctcaccagggaagccccttctttatctgttttatatattgaacaatcaagatcaattctagttgaaaaaataattattgcttaacaagttttgaaaaccacggtactatacttttaatatggttgattagaaggggtcagggaaaggggtcagttcaaacacaaatgaagctaaatatgtctgaatacggagaaaaaaggaactccaagcattgttttcatcagaacagttaaagacttgaagccttctcaaaagaaggcccagttgaaacaatagtttatcagagcaacaactcagattgccagtttggacagcacccaagtactacttaagactcctccattccccaggtttattttcagcatcatcctcaagcataatgtgctttcccaatgcactattgcaacaccactacacatgaggtagaaacagaaaccttgctaaacaggttctgcgtttggcaaaagtgccatgaatatgggacattgtacatctccatgcctggggaaaattcctcggtctttttggttaacaccttatagaaatgtaatgcatggagttctctacatgagcacaaagtagactaattgatacgaagagccctgtaaatatgtgtgcagcggcagattttgaacatttggaccgaactgtatttgacacagcgcaatatctggaactggttggtcaaaaacctgcttgtcttgttaaatttcctctgtccaaggacatggaatctctctctaattttacttcaaatttccctttccttcatttctctaaaaacgttaaataagaaagaagattgtaaagccagcatttgaagcctaagtattgaaagtctttgacaatttctgaaatcagacttgacatctttcccccgccttgcaaatttcttgaagaaataagaagctacatgtaagcatcatcatgtttattaaattacaatgagaactctcactcaatcttgaccagagcagactcttaacttggaagcagagtccctctaaaggtaactcttgtggtcactcaatattgtattggcatttgcatattaaatagacatttcagtagcattt

SEQ ID NO: 69399 - DNA, 2218 bp, Homo sapiens
  misc_feature (1253)..(1253): n is a, c, g, or t
catgttgaccaggctggtctcgaactcctgacctcaagtgatccacctgcctcagcctcccaaagtgctgggattacagatgcgagccaccatgcccgcccccccaccccccgtgcattgtgcctttgctctgcactaggcaccctatcaaaacttgaagatcctgccctaacataagcctcataacgactgtgaggtgggtattatctccactttacaggtaaataagataaaaacagaatagtactttcccacccaggatcacatagccaggaagcaggggagtcagaatttgaccccaagctgtgttcttaactcttcctgcatgtaaaacattcctctccttactaagtgtgacctgcagaaaagtcaccacatttctcagagccccagtttcctctctataaaatgggagcatcaacacctacctctccttctgtggtttggatataatatacatgaagtacctagcataggtgactgacagatagaaagtatttacttaatggcgactctttttgagaacagaaatgaccatgagcccattatctgccccctcccaccctcacggatctgcttatcttccttggtcctccgtctcactgaaggcaagcatgtatttggctctgtttacctttccctctctcctgtgactggtggcaaacatgaagatcccccaagagccagctgccagccagaagcctgccttcttacatgaccccatggcagcagggcctgagagcactggtcttgggtgggatggggttcagagcaactcagggctcagggatagggtagcagcgctccttgtcagggcctggggccaggggtgcatgggcatcaacaggacccagtgtgaagtggaaggtgctaggatcaatgctctaaaatcctctttgcaaacagatactcctctgttacttgcagtttgtcctcagtttataatcaggaaaacctgttgattgcaatgactgtagctccaatcatatattcatcaggatgtcattagttcttttctcctaaagccccagagctgcatccccctaccctccctgatgccctagaaagaggagtgctagcccagcgggacatccagttgcccaccacctcctccagcagctcccggccctgtgggtggccacatgccagccaagcactgggcttctgtgacctgaagctgctggatgacttatttccttttaataagactcctaatttgatctcaatttcaaaaaggcaaaatgatgaagganttctccctggagacattctgccctgtggtctgattttgccctggggctggatcaggctttcttggctgctctgaggctcagccctggcttaggtaggagggagccttagggtgctggcaaagcagggaacagtgggctgccgattacctctgccagccaccccagcctcagatctccccagttctggagcagggctcctgtcaccagcgggttggaaggaactgctttaaatgagggtggctgcctgccagatgtgctgattcagctcagcctgagcatcactccattgtcacatctgtccccaactttatgtttgggcttcttatcttcagcagctctggatgctcatttagatccctcaactcccctcgggcaacaagcacacacatacacacacccccacacacacggaattcatctcgctgctgctgggagatgaatttgcacattaaaataggtgagttaacgtgcaaggtgatttacactagatcaaaggcacagcaagatagtgagaattattggaacaagaggctgaagaaaaggctcctagaatgtccaagctgaaaagtattcagggatcatctaatcctctacagtcatccctttgtatccaccagggattgataccacagataccaaagccctgggatgctcaggtcccctatatgaaatgcatcatatttgcatataacctacatacattctcatatactttaaatcatctctagattgcttataatacctaacacaatgtaaattctatgtaaatagtggatatactgtatttcttaaaatttgtattattttttattgttggagtgttatttttattgttttttccccaaatatttttgatctgcagttggttgaatctgcaaatttggaacccgagggtacagagggctgactgtatctgctttgttggagtccatctgattcattgtctaaatacaattaattgctcc

SEQ ID NO: 69400 - DNA, 580 bp, Homo sapiens
cagatttagggcaaagttaacacttcaaaaatatctccagtaattgagtaaattgctcatctgtcaaattggctctttggcaaattactctgcttgcacatattaatagccaagcttagccaacttgaaatatggagatttactggaaatcacagtgaagtgaagagagaggcaagagcagaattgaaattcccacctggcagcaaaagagagttatgcagagcctatcaggacccgtgttcacaccagcacttagtttggaggaagcacctggaggagatgcagagtccagatgtgcgccctctgccggaagcctactgcaccaggacgtaggcctggagtggcccttaacgcatttggaaatcagtcttcactaaaaaaacttcctccaaaatgttctttaacagccctttaaaagccattgtttcaaaacagtccaaggtggtgaacaattaatattttcgatttacatgaagactctggagtaggaattacctgagttggaaactcagttctactctattggtatcaggttgcattctgtatcatcattaaaattttcagaaaaactctcaaaaaa

SEQ ID NO: 69401 - DNA, 458 bp, Homo sapiens
ctcatatctccatgctgaatttcctcactcattcacaaccctcctttccatttcaagaaatctttctgttcccacaagcctgggagggcctttgagtggggcatattgggacccgtgttcacaccagcacttagtttggaggaagcacctggaggagatgcagagtccagatgtgcgccctctgccggaagcctactgcaccaggacgtaggcctggagtggcccttaacgcatttggaaatcagtcttcactaaaaaaacttcctccaaaatgttctttaacagccctttaaaagccattgtttcaaaacagtccaaggtggtgaacaattaatattttcgatttacatgaagactctggagtaggaattacctgagttggaaactcagttctactctattggtatcaggttgcattctgtatcatcattaaaattttcagaaaaactctcaaaaaa

SEQ ID NO: 69402 - DNA, 460 bp, Homo sapiens
cacaccatcattataattctatgcaattattatttaaaaattaaaaatttataggccactcttctatctcagatggggtagaaagactgtgagttgtgcagggacttaagcaccttttacatgtgttttaaagtccattagttgctttattccagtgaagaaatgggatatggtagtgagaacatcatggaagaagctgttaaaacatttcctttcactttagcttttctttccttttcttctacgcacctcctattctttttcttttcccatcccagttcactgatatccaagtgtggatggttcatgtcagacacttaaagtctgaattctctacccacagagctacataattactggacagattttctgccatgctgtttggaattatcaagaaagataactaaattcgacttgctttatactctcataaacactgattcagtatccacaaagcctg

SEQ ID NO: 69403 - DNA, 328 bp, Homo sapiens
gaaagtaagagtggtagaaggaaaagtggcagagagaaggcaaagataacaggtctgcaggttcctcctgagcctgctttatgcaagcaaagacaacagtcaccagcctcaaagcccatttctgcagcacagccactccgtttcttgggttgtgccttcttccatatgtgtgatagaaagctataaaatactacttatatcatgcccccaactatcacttaatgcctgtatggaggcatgaaatatttatggtaatgattagagtctggcatgcatgtgttgaggttcaaagttctttaagagaatctccattagcttaataaaatgg

SEQ ID NO: 69404 - DNA, 325 bp, Homo sapiens
ctgaactccagcctgggcaacagagagagattccatctcaaaaacaaaaagaaaagaaaagaaatatgatgctagttgtcattactaaaatgattctgatcaaacaatttgatgtggtttagatgtgtgtctcctccaaatctcatgttggaaagtgatacccagtgttgaaggtggggcctgatgggaggtgttggatcatgggggcagatcccttatgaatggcttagtgccactgccttggtgatgagtgagttcttgctctgttagttcaggtgaactggttgtttaaggagtctggcacctcctcctctctcttgcttcc

SEQ ID NO: 69405 - DNA, 335 bp, Homo sapiens
agaggcataataatccttgttatttcataaattcaaaattctagtttcctgtctacaacttgacctttaccagatacattctattgtgactgaattatgtcaattcttccttgattaatctttttaatccattctctcctttatcattgtttatttgtatctcatgtaacttattcttgtcctacatgtaaacaatggtttcctgaattccaacatcattctgccatctgatcctttcagttttagctctgatcactttccaccacacatttttttctacaatctagacaaatcagtgcatttctcaaaaatatgctatttcactttgtgatttt

SEQ ID NO: 69406 - DNA, 433 bp, Homo sapiens
ttagggtctgtggaggctttcttccattcagtgactcaggggtccaagctccctccatctggtggcctatcatcttaaaacatgacctcttcagggacaagtgaagactggcgcaggatgatttttaagactgaggcctgggctgggcgcggtggctcacgcctgtaatcccagcactttgggaggccaaggcgggtggatcacctgaggttgggagttcgggaccagcctgaccaacgtggagaaatcccatctctactaaaaatacaaaaatttacctggtgtggtggcgcatgcctgtaatctcagctacttgggaggctgaggcaggagaatctcttgaacccaggaggtggagtttgcggtgagccagggtcgcgccactgcactccagcctgggcaacaagagcgaaactctgtctcaaaaaaaaaa

SEQ ID NO: 69407 - DNA, 250 bp, Homo sapiens
ggaagactgacattcagtgtgggcggctgcaatctctgctccttcattcatggcagacatggatcattgatcactgcacgctccctgctgaacccacacaaggcctcagagatctgttccacccagagctccaggcagtccccacctatggtctgccgttgagaggaaacatcattgttgtgggtaattgggagccactgcatgttcttgagcaggagaatgggtgtcagaacaggttttgtgttcctgg

SEQ ID NO: 69408 - DNA, 2641 bp, Homo sapiens
caaaaaaccaaatggatcttgttccgcatagggcagacaggacccagaggacacagcagtccacaacaaaggcactggattctgaatggcccctgtcttgtttggggagaggggaactgttggtccccgtctgtgttccgaggcttggtgacaaattctagcaaaccttagtggtttaaaacagcagtccacatagatggtctctcacagttcctgggaagcaggaccctgggctccatggcaacctggttctgctctaaggtctcaactgaggtgtcagtgcctgggtttacctcgaaggtattgtagtggggtaggttgggcaccccccttcacatccagctggagccttggagcaggacctcctgtagaaccagggtcttggcagacatcctcaatgagtgacgtcgagaccaggccatcctggattagggtgggccctggacccgtaacaggtgatcgtctaagagaaagaggagggggatctgagatgcacagatcgggaaccagccatgaagacaggccagagactggagtgtgtggccatgcgcctgaggcacctgagccaccaggagctggaggaggctgtgcagggtcctccccagaacctttggagggagcatgcccgggacacctcaatgtggggcttctggctgcagagttgcgaggaaatacctcccttgctgttgtgaaccacccaggttgtggtaacttgctgtggccaccctgtgatgccagtatacctccttccctcatgtctggtgccaaggccgggagagtcaaatacctggggctaaaagcattggggttcctcagatgatcctctttgcacccctgcatagggtgtctgcccacacggcctcagggtcatgagttttctgcaggcagccacctgacctgtccagccggacatgtgtctcccccatgggtcagtttgggcagcaggttgggtcccgtgtaaggctcagggctgctgggctctgatgtcacctgttgccacggtgactctggttgctaggatcagactactcccttcctgggcacactgtatcccgaatccccagaagaaccaaggggatcccccagcacaaggctcgttggggagggagtccttggcgctcagatttgagagagagagtcggggctggccagggggcgtggcttgggcagaggagagtgctcatggtgaccctggaggagaccctcccttccctcgttcattgctcccaaggccaggtgtctctaaaggaagccagttgtggagaatgttggtcctgcagtggcgattaatgcaaagatgccctgaacaaagcaggacacacgtgcctgcctgctacccctgcccagctgctgttcttggacgcatgtgctcttctggtgggacccgtgaatacgtggctcacggtcctggggcacaccccattgtgtgaggctgggggtcttgtggggagccaggcccctggtgtgggtccctgctcagaagccccacgcagcccctgttctgctgagtgcggctgaaagccccccatacccacagccctctgtcctcaaatttttctcattttaaaaattgtggtaaaatacccataacataggacttaccattttaaccttttaaaaataatttaaattttttaagagacagggtcttgctctgtcacccaggctggagtacagtggcgtgattttggctcattacagcctccgcctcctgggctcaagcaattctcccacctcagcctcttgagtacctgggatggtaggcacgcaccaccatgccagctaattaatatattttttcttgtactgactgggtctcagtatgttgcccaggctgatctcaaattcctggcctcaagcgatcctcccacctcagcctcctgagtagctgggattataggcgagagccactgcatccagtgacttttttttgtttgtttctctaatagctgccatcctgatggggtgagctggtgtctcatggtggttttgatttgcctgtcctgaaggactcgtgactttgagcgtctttccatgtgcttgctgctgtttatagatcttctccggagacatgtctgtcttccctctcattcttgcatgcgggcgtccacaggctgacccctcagctgctcagccaggcccctgctcctgtccacagagcccaccctccaggtgcactccctgcctgcctcctgcaggttcctttcctgggcatggtggcccagccctctctgtccctcacctcacctgctttcttcatggcatgtgcacatctgacatggttactagttgtgtgatttctgtctgcctttgcagtggacacaccacagacgctcagccaatgcttgaaccagcaggtgggtgggactatgccaggacgggatggtggctcagagaggggctgcctggtctggggcctgacaggcgggaggaggagaggcctgtagcacccattggaggtgtgtggtcgcccagcacaagaacaagggaggaggcagtcaggcgggggcgctcctgcccaggccacggagctttaattaaaacccgcccggagcatgaccccactctgccatgcattcttcacttaattggggcccttcaggaggggccggctgaggttaattaaaaagcccagctgaag

SEQ ID NO: 69409 - DNA, 573 bp, Homo sapiens
tgactgataggctgggtcaaatgctttcccttactccttctttgggagataggatccctctttattatagaaaatgtgttgttgttattattattattattgagatggaatctcactctgtcacccaggctagagtgcaatggcaaaagtgagccaagattgtgctgctgcactccagcctgggcaacagagggagactctgtctcacaaaactaacaaacaaacaaacaaaccccatggacaaatggataaaaaagaacaagttgtcttagaaatcaagggaaaagagcatttcatcaagtatgtacaggatcggctatgtaggagttagctgtgtgacactgggcaagttaacctctcttagcctcagttttcttattcgtaaaatggagatagtactagtacttacatccagggttggaaggattaaatgcaatcatacatgtaaaggcttggaaacacatacacataagctacaaagaaggaagtggctaactatccaatagtgatctaaaaagacaaaatctgaaaagtttccattggaatttgcagcaaggaagttataggtgaccc

SEQ ID NO: 69410 - DNA, 215 bp, Homo sapiens
cagggccgccacctcccttccgtctgggtcagggctgcaggactgcaggcacctttcccaccactaccccggtgggtaagagccaaatgccggcccctcgtctccaccatcctgttgtgtcaggcctctgtgtggacccagaatgccttcctgtgctgcctgccccaggtgcctccctgctttcagcctcatctctctaggtctgtctccactca

SEQ ID NO: 69411 - DNA, 764 bp, Homo sapiens
acaccttaccaagtaagagagttgaaccatctccacatgacaatggaagctccactctcaagcaccacagccacaaaggaacattctattgattctgacccatcctcgggaagttggggatgaacatggtagggagttcttgagtaatgagaaaaacatcctgagaatacaaactttatagggttgttaagtatatggtatacagagtagtgaattggcatggtattcgcttacagggaactcacagtcaagaaagttaatttgctgaatgatactaacatctcctctgctacattcatttctttttaatgatttaatggataattttttaggatttaatggttaattaggatttggacatatctttgccaacataaaaagagactaatgatgtaccttgctcttttgaaaaggaatatgatgttcaagcagcagtaacagatattctggagccaatcagtatgaggattagcagccgatcttctacaataatgtatatttaaaaattaagtgaaaatgcaataacgtacgtccattggttcgatatagaagggtgacatttcttttctaaaatttagtgcttttggtgcagtggttcttaaatttgttgtgctgatgaagcaccttaaatgcttatgaaaagggcatatttcatggacccatgacgagaaatggtctgatatgccattaagatctgctttttcttttcttttggtaaacaagcatctcaggtcatctgcagagtttgagatatccattgtccc

SEQ ID NO: 69412 - DNA, 448 bp, Homo sapiens
tgtatgggtgggtgaggcacgccatgcaggtattgcagaaggaacccacgcaaccgtcatcctttctacccccaagtgatgctgcctcattctggggtcctgaaagtaggcttcacttaacatggtagggaagtttctggctgaaaaagcaaaaggcttttatcactggagtctatcctgagccccctgtgcaaaaggcagtgtgaactcaggggacagaatcactgaagcttttgtaaaagcacaacatctgcctatcacagtccaaaggggacttcaaaatcaagaatgtctgtgacggagaagatggaaacagagcctggctgatggttgtaggtgaatcttctctgtgtcgagatgttatcagtgaccgttttctttatttcatgaagaaacatttttaatatattcacctccctgcatatattctgtttactgtgttattgtt

SEQ ID NO: 69413 - DNA, 407 bp, Homo sapiens
tgataatctatatatggttacctctacagttactggcgacagatttggactgccagtttctgtgagtactttatatgacttttctggtaaaaatctattctgacttggaagaatcagccattctggagagaagaattggctttgtctccatggtaacttatttttctgttttatgtgaatagtgacggccaattgtgctaaagtaagggtgatagttttgtgatgaactactttacatggggattgaacattagaacactgagcttattttactggaggccgagaagcaaaaggctttaacatagcaggttggtggtcataatgtacaatatgtatttttctattctcttaaaattttaaataagctcaatatattattctacattgtgccctaatattttgcagaa

SEQ ID NO: 69414 - DNA, 620 bp, Homo sapiens
ttacttgtgcgtgcactgagggatggggcgtacctccatcagaccaactcagaggcagctttgcgggtgcactgagggatggggagggcacctccatcagaccaactcagaggcagctttgtgtcttacattcatctttatatttgtaaaataacaaaaaatttatatcattgtaaatttatatgtgagtagagactgttcatataaagcaggacttctcaatctatctgtcctttttttaattaatgtgcaattagtcatggactgatagttttgtaaaaagtgaattcctgggaaaacaagattagaaagcaaagacagacaaaattcttttattattagatttaacagacatagcattactctgctggtttgctataaaagcttctgaatgcttctctcggtctctcttactcatatcttcatagacttgtaatagtttgcacatgggcacctgttccagaacacagattgagtggcactggaatgcccacgcactcagcacccagctgcaatgatttgcaactccttagctaattttggatgatctgtgcccccaccacttcccctttctcctatatcattttgaagcaaactccagattcatatcattttatctg

SEQ ID NO: 69415 - DNA, 382 bp, Homo sapiens
caaagttaaagatgctgtgaggcagtaaagagggatatattgaacacagttgctgatcgttgtgaaatgctatttgaggatctgcttttgaatgaaattccagaaaaaaaaagattctgaaaaagagttccacgtcctcccttatcgagtctttgttccccttcctggatccactgtaatgttgtgtgattataaatttgacgatgagtcagctgaagaaatcagggaccattttatggagatgttggatcacacaattcaaatagaagatttggaaattgcagaggaaacaaacacagtctagtatagagatggattaacagtaggaagagtttaatattactagaacaaaggaagcaaaacagcaatttggaaagtttag

SEQ ID NO: 69416 - DNA, 433 bp, Homo sapiens
catgtaactctgggaagttgcctgtgggggacatggaggaaaaaaacaaaatcctcttccccagtctggtcaatacacccatcacacatcaatcaagtgatggagacactggcctggcccaggataaggatgctggattcctgggatcctggtgtgcaaatcacctgatgaaataactaggagaaaacatttctatccttaaaaaaattatagctgaatgcgaggtggctatagctttccaaattcaaaagatgtgaaatgagccagcctggtttttctacctcaatgactcctaatcccacgtttaggactcctcactaataattccatcactctgcattatgctatacactaggggcagtcatcccaaaacgaaggaatcactcgtcgtctttacttcaggaaatttcttggtaaaactgacttcaagaaa

SEQ ID NO: 69417 - DNA, 487 bp, Homo sapiens
tacaaccacttgctttggcatctgagagccttggatgggaatgtctgctcctccactgacaagctgtgcagtcttgaacatctcaccctctctgaactctagtggatttttctctctggtcgggaatagcatggtgctcatggctttcagggagcataagggctttaacacttgtagagccctggccgagttcctgcttggaggaaggtcgcccactgactgctgtcttcagccaggtctccagactcccagggcttggatattttcagtatttcctgttgccttccagtagtagaatttagaaaggccagtcaaccttagtggctttaacaagaatcttttgaggcagcgttatcactgcaatgaacttcaaatcctaccttttcccatcctagccccgcccagccctccccctggatttcagagaaaggccttctccaggtgtccgcatgtcccatttgcaaaatgcctctcgaaattggagagt

SEQ ID NO: 69418 - DNA, 659 bp, Homo sapiens
ctctgcaccccatccgctggctctcacccctcggagacgctcgcccgacagcatagtacttgccgcccagccacgcccgcgcgccagccaccatgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgatccagcccagagacactgatttcagacctcttgatgagagaaagcacagaaaatgttcccagaactcggcttgaagaccctgcaatgtggtgatgggaaatgagacttgctctctggccttttcctattttcagcccatatttcatcgtgtaaaacgagaatccacccatcctaccaatgcatgcagccactgtgctgaattctgcaatgttttcctttgtcatcattgtatatatgtgtgtttaaataaagtatcatgcattcaaaaaaaaatcctcctcaatgaaaaatctattacaatagtgaggattattttcgttaaacttattattaacaattagtcattatagtctccctcaactagca

SEQ ID NO: 69419 - DNA, 1072 bp, Homo sapiens
attcagagacaaggtctccttctgtcactcaggccagagcacagtggtgcaatcaaagatcactgcagcctcgagctcccagcctcaagagatcctccctcctcagcctgcccaagtgctaggattacagttgtgagccataatgcctggccagggttgtctttaacactaagcagtaaatgtctttccatgtttcactgacatgcatatgatgtttgccacagtaaaaagtttagggtagactatatcgacttactgttagaaaaataacaacgcagacctacttagaaccttggtttttgtctttgttttgtggcccaaggtcacacagttagtgcatgaagtaaaattaattgcaacctgattgacagactccatcaggtgcagttagaaggagacaaaacttgacggtcttgaagttgcctatgagtgctattttattaaaaaggtcttattatagtctaataagtagcatcttactacataataaagctggcaggaaaaggaagcatatttagagttgaggaacaataactttcctgtcacagcttcatgtgatttctgtaattttgattttcaaaagatcggggtgttcttcggctcctttgatacatacagagcctttcaaatgctctctctgatgtttgcccaagacgcctgtcaacatcgtggaatgctgctcagctggggctgtgcatattgtgcctccgcctcacgatctgatattccacatggcttcttatttagaatgccaacaggaaacttttcaacagttcccggtcatctttcacttcagatctaaatgtctcacccttgctcatacctcaggaagttgggcagctttccttacatgctttgcttcttatgttttacaggcttgaagaccctgcaatgtggtgatgggaaatgagacttgctctctggccttttcctattttcagcccatatttcatcgtgtaaaacgagaatccacccatcctaccaatgcatgcagccactgtgctgaattctgcaatgttttcctttgtcatcattgtatatatgtgtgtttaaataaagtatcatgcattca

SEQ ID NO: 69420 - DNA, 558 bp, Homo sapiens
ctctgcaccccatccgctggctctcacccctcggagacgctcgcccgacagcatagtacttgccgcccagccacgcccgcgcgccagccaccatgctaggtaacaagcgactggggctgtccggactgaccctcgccctgtccctgctcgtgtgcctgggtgcgctggccgaggcgtacccctccaagccggacaacccgggcgaggacgcaccagcggaggacatggccagatactactcggcgctgcgacactacatcaacctcatcaccaggcagagatatggaaaacgatccagcccagagacactgatttcagacctcttgatgagagaaagcacagaaaatgttcccagaactcggcttgaagaccctgcaatgtggtgatgggaaatgagacttgctctctggccttttcctattttcagcccatatttcatcgtgtaaaacgagaatccacccatcctaccaatgcatgcagccactgtgctgaattctgcaatgttttcctttgtcatcattgtatatatgtgtgtttaaataaagtatcatgcattca

SEQ ID NO: 69421 - DNA, 402 bp, Homo sapiens
ggatccggttgcagtgagccgagattatgccattgcactccagcctgggcaacaagagcgaaactctgtctcaaaaaaaaaaaaagggatgcagggcccagacaagagaagagtcccatcatgcaggtgctgggcccagtgatacatctaaatctttttttgttcagagtccaagcagtagagaagaagtcacattacctaaatgctgcatccagcaacatgtcacaatacccggataaggagagcccaggcagaaaagtcacatcacctaggtgaaaggcccaggggtatttcctagtgctacttgtttgcagagctcaggaagaagacaagagtcagataacgtaggagctggtagcacaatcactacagtgggcagggtctagctatgagaggagagtc

SEQ ID NO: 69422 - DNA, 560 bp, Homo sapiens
ctcctgtaaacagcctctctgacttctcttctcagatgccctttcaagggcgacagctacagaacccaaatggtagccttggacggggccacaccctttccagtcgcactaccagcgattcactgttgctaccttcgccctcctggactcaggctcccagagagccctcagaggactggtttacttgttctgcagcacctctgcctgccacacctcagggctggagacttgctccactgcatgtagcactggcactacaagacagcgacgatcctcaggtcaccgtaatgacactgccaggccccaggacatcgtgagctctccggggccagtgggctttgaggattcttatgggcaggagcccacacttgggcccacagactccaatgggaactccagcctgagacctctcctttgggcggtccttttgctgccagctgttgccctggtccttgggtttggtgtctttgtgggcctgagccagacctgggcccagaagctctgggaaagcaacagacagtgaatgggcccaataaacaatcatttcaaacctactgaaa

SEQ ID NO: 69423 - DNA, 401 bp, Homo sapiens
gcttctttaaaaactcaatagtaagcattttagaactttttctaaatttgaatagttgaagtttcagcttctgttttaaccagaatttattgtaaatggccaaaatacctatctactgctaaacatcattctggaattctgtttatgcctgctaaactattgcatttgcatcttcatccttttaaagatggagcaacttaaatgcacatagcaatctttttataaaagcataattatgtcttgtgctttttaaaatgaaaaactagtcctatatgcattattggtttatgtgaaaaagtaattcacaaatggacttctgtataaatacatgttttaaatagccttgaatttttcttgccttgtactttttatgtaaataaaattaagcaattgtttatcgt

SEQ ID NO: 69424 - DNA, 162 bp, Homo sapiens
ttttttctgtttgcttatttcttttcacccagacacactgctgcttgttctaaactatgcatattggttatggtatggtcaagtcagtgtagccgctggaggaaagaaaaatgaagcttgcaaggaagaagttgtttaggcccacaggtcccagagaggagg

SEQ ID NO: 69425 - DNA, 328 bp, Homo sapiens
gacaacctacagaatggatgaaaatatttgccaatcatatatctgaaagggtatagtattcagagtacattaaaaactcttacaactcaaaatacaaagacaaataataacccaattaaaaaacaggcaaagcatttgagtagacacttcttaaaaaagatattcaaaggccagtaattacatgaaagaagctcaacaccattggtcattaaggaactacaaagccacagtgcatgtatgactataataaaaaaagacaatgacaagtattggcaaggaggtggagaaatcagaaccctcatacactgctggtgggaaagtaaaatgg

SEQ ID NO: 69426 - DNA, 445 bp, Homo sapiens
  misc_feature (394)..(394): n is a, c, g, or t
ggtagtggcatgatttctgcttttgtagttctcttttgtttctataggaccgtgaatttccatcgctcgctttctctctgtgccacaaacttgtcaaaggatgtcttcccacttctaagttgtctctctccctgccagaagcaatgccttccctaattcctggctgcatgtattttcataccttcccttctgttcagttccttagtagccactgctctgatccactcagacctatcctcattattttcccacttgggaatgggactgtcttttgtgggtaacttttatctgtctgacctttctgggaaccctcctgccctctccactgcatagtctctgcctgactgtctaactctagtgtggggctttgggagctgggttttggggggttcantttctcttaaactttccataaggttgaagtgtgtaggtattttctgactcc

SEQ ID NO: 69427 - DNA, 310 bp, Homo sapiens
ttacaaatttagctcttccacttctcttggcgtcctttgggcgtgcgttccacagactgcacttgaccttgtatcttgtaaggaggtgttctttctccagctgccaaggttccagacctgctgatttcactcctttgtatttcctactgggcttctggaggaattttagtttgtgatgcccgcatatatgtgtaggttatatatagatatcaccttttacattttcatttagttttggacgatgtgtttctgtgattcaaattccaaagattccattctgggcaacaacacaagaccccgtctctacaaa

SEQ ID NO: 69428 - DNA, 648 bp, Homo sapiens
atcgagctgtgtgacaagggtgccagccactccaggtgaagacaccaccccaggccatcaaggatcttccctaccttcactaaacagagcagggtgaaagttgtgtgatccccaataggtagggactacaccccaagtcagcaggaagcagttacagaagaaagaccattggtccctctgcttcccataaagatttatggggatcacagctttcacgggggagatgaggcaagagaatagggcatgcaggcagggtacttgaggccaatccacgctgacttcctagaactgaattaaatgaaagctcctcagcaatgacaggaatgtgaatggctttgtaacttcttcctctccattaatgctatttccactttgtaacttcactttcatcctctccatttacatagatcacacaccaagtaacatcctctccatttacagtagggcgcattccgagtcaatgactctgactgcacttcgttctcctcatttacatagaacattcgccaagtaaccaatgggaaacctctagagtattgaaactccagaaaattccgtaagtggggctcttgagcgtctacactcgggtcgctcccacactgtggcgtgtacttttattctcaataaattcccgcttttgctttcaaa

SEQ ID NO: 69429 - DNA, 5003 bp, Homo sapiens
  misc_feature (1413)..(1413): n is a, c, g, or t
  misc_feature (2197)..(2197): n is a, c, g, or t
  misc_feature (2487)..(2487): n is a, c, g, or t
  misc_feature (2745)..(2745): n is a, c, g, or t
  misc_feature (3123)..(3123): n is a, c, g, or t
  misc_feature (3889)..(3889): n is a, c, g, or t
ggcttcaggtttaaaggcgcgagcgccacccacgcaggcacaagggctcctagtcgttttatttttagcgtaaggtcttcctctttaacaaggaagtaaaaaaaaaagttgtgcaataaatattaatcgtccttatatgtactcgggaacgttcgtcctttaggttttttcctggcgcatgggcgccgccaatcatttcggggcttattttggttctaaagcccggggcagccaggcctccctgcctggcctcggcggggacgcgggacctggggccccggaccgggcctaaccgccctggccggtccccactgatggtggcggtcggtcctgatcgtcctgatggcagcgaccaggctggactcgggctgtgcaggggcgaggggagcagggcggggtgacgcccggagagcggcctggagagcgcgtgcttcagaaggcgtgggcaccctgtcccctttgcagatggggatgcaggccctggtggcggtggaggggagatgggggcagggacgttgccgggcagaggaagctgggtgagtgtgcacttggtcccctttgctcctccctgggactttgggctctatagggcagcctccgaggcccacgtgcacactcggtgaaccacagtccagacacaggcagggcggcaggccagggaaggagaggccaggtgttggtgcatggagaggccaggtgttggcctgggggtgctaagtgaacccccaaggtcgcggagacagtagggcaacagcaaaacgagctctgccgtccagggcgagggcccggagtcctccccaggggtgggctgcagagaagcccctgtccaggccctgctcacctgcaaagtgctcccgagctcctgtgcccccagcagcaatcccagccccgctgacacccaagcttgtcacccgctgggtttcttgaggtctgaggaccgtggctgagggtgcatgggcgctgggatggagggggatgtcctgtcccagtctgtgcttattaattgttaaagagggcaaggctgcttttattcaaggtgggggggctgctaaagcgagatgttgggttaggggaggcagatccggctcaactccagatagaaaaagtgggaattgacagcccaggcgtagggtcgggagtggagagaaaattactaagaggaagggtcaggggcaaggcgggttctagctgcatagacaggatttttgctgaaaaggcaggcagtgtggtcacagaccgagggtgggagttgaggactttgatcagggaccaagagtagacgattttcactaaaccgactcagcaggattcttgctaaatcggccgaaaccggccaaggtcagggactggtcacagggagggctcagaggagcctgactcgagtgtggtcaaaggagagagtctttgtcatcntttaagaggcgagagtgacgtattagtgagaaacggtgaagggatcaagctcaggccagcagccccgagtttgagatgaggacaggctgggtccaggaagggctgcaggaatagggggcacctgagcctgcagaaagcggggagcccagccgccagagcaggcacccccaggcagacctcagtgtgtcctgccctgtgggagtggcaaggccagaccaagctggatgtgaaccagtcccagaacaccgcctagaatttggattgtaatttgttatcgatgatattgctgcttggtctctctcctcttcctccccacccccacccaagatggagtctggctttgtcccccaggctggagtgcgatggcaggatctcggctcactgcaacctccgcctcctgggttcaaacaattctcctgcctcagcctcccaaatagcggggattactggtgcgtgccaccacacccagctaatttttgtatttttggtagagacggggtttcatcatgttggccaggctagtctcaaactcctgacgtcgtgatccgcccacctcagcctcccgaaatgctttgggattacgggtgtgagccgccgcgccgagcatggccatcgtggctacatcagtcccggctaatagagattttagcacactcagattctattggctaataagatttaattataattctggggtatttaacaatgtcgttatacagtcttcattgttgcaaatggagaatgaaatcgggtgcatgtgacactaatatgacctgttcatgcnctgtcacttaaacggagttaagtaacatagccctgagcaggaagactccttccccacttctgtccaggagctccttactcgattctggggaacagaaaggctttcagcggccaaggggagtgacaacagccagacatgagacacctcctagagccctttggtgttaccctttccggtccatcagccacagtgtccaccccaggtagctgggtcctgagttcaccgtctcaggacatttttcgacctggtttgtctgaattattattattattgatcattgagacagggtntcagtccatcgccaagactggagtgcagtggtgtgatcctggcttactcagcctcccaggctcaggtgatcctcccagctcagcctcctgcgtagctgggaccacaggcaggcaccaccatgcctggctaaattttttgtattttttgtagagaccagctctcgctatgttgtccaggttggtctcaaactgctgcctcagcctcccaaggtgctgggattacaggcatgagggaccaagctcagcaatctgaattanttatgcagaatttttttttctctagctggaagagctgtttatatgcacgtttctttgggggcaactcttctccattgtcacagattttttttttccaagccattcctgggggattcctgggagccatgtgggagaggcgtgaggaagtgagaccttcaccccgagacaggtcctgacacaccctctggtgcctctactcaagtgagaagtttggctgctgtaactgactgggaagcttaaaataacagacaatcatctctcacatttatggggactgggaagtccaagaccaagttgccatctggggagggcctgttcctcacagcgccttccagctcaggcctcgtttataagggcactcaagccttccacgacaangggtcctcatgacttactcacctcggaaagccccacccccaagaccatcacattgtgggtgatggcagagcataaggtgccttccccacatgctcgggttggcccagcgtctcacgctagcagctacgtggaatagttattttttctggagaactctgggacccctctgatgtcttggagcacccacacaggccgttcactgtgcacgctgtgaggctgtcgtcttggagcacccacacaggccgttcactgtgcacgtggtgaggctgtcctctggggagttctgctgttgtatgggttctgtctgtgtcaatgtcccagcgggaacgcagggcacactagcgtcatccccagagggcttggtaaggggactgtttgcagagacataggcagagggctggaaaactaccaaaaaagtgcagtgttctggacctaataatagcagagctattctcaccctggtctgaaggcaggaggggaggagcagttaatggattctggaagtcaggttgcacagagtcaccttgaaagatgccatgaccttcaccgagggccagacagagactaagatgaccccataggagaataagacctagacctcatcctcctgcctcctgccagtccctgccaggggtcgccaatggcaaaacaggactggaagccagaggccatggaagcccatggatgaagtccacaggccagcctccccgagagcagcctggacggtccgcaggagacgtctcctgtcttaggcgtcccacgccgngtgctcctgttcagccctgccgaggtggaagcttggagtggctcacggtggatgcattgacgctgcagacgccagcaagtgctacaaaccagagctggcctttaactcagactgatggagaaggtgttaataatgcagattagacttaaaagtgttgaagccattgcactgtgaacagcaaaaaaattgaagaactcttctggcatttaaaaacaattactcagttcagcagagaagtcactgacaaacgagatcacactgactgctttgtcgttttggttttgtcttactcattaatgcaaataagaacattcactagcatctgtgtcgggcctaccctccctggtcaaatacagctacagtctccctgcagatacgagttttccagaaatgagccgatgttttctgcgagaatcaattggtcatatacaatttacaaaaatgagtactgtatactatatttgtaaactgtacactgcagatgctttatttcactgaaatttataatacacttatccatgtatatgcatgcatgcatttttgttcctgagatccagctgtgaaatgtttaccagcacataaattaccagcacatgctcttttttgttaacctactaggtaaaatcttcatttattacatcaaattcttgtagtttttgtattgcaattatgcagatattgattatcgcagtattactgcaattatacagataccacaatttcagatattgatcagcgtgttcagttggtttctaaggaggtttacttacctcatggtacacctagtttgcatagtttgattatatttaactcttatgctaattgggggaagtcattgatttattggacagatgcacctgtggtcttccctgagcacatcctggccaaggatgctgcccccaggagatttgagaagtcctgtaaggatcatatcagtattttcaaatacttatagaaaagccagagggattgacccagaattaccaatataagcttgaccctgagataacaatgccattttatgtttgcatgcataaaaccaatgcaagaggctgatgactccagatcccttatataagccaataaaaagtagtttcattttttatttcattta

SEQ ID NO: 69430 - DNA, 2588 bp, Homo sapiens
  misc_feature (708)..(708): n is a, c, g, or t
  misc_feature (1474)..(1474): n is a, c, g, or t
ggcttcaggtttaaaggcgcgagcgccacccacgcaggcacaagggctcctagtcgttttatttttagcgtaaggtcttcctctttaacaaggaagtaaaaaaaaaagttgtgcaataaatattaatcgtccttatatgtactcgggaacgttcgtcctttaggttttttcctggcgcatgggcgccgccaatcatttcggggcttattttggttctaaagcccggggcagccaggcctccctgcctggcctcggcggggacgcgggacctggggccccggaccgggcctaaccgccctggccggtccccactgatggtggcggtcggtcctgatcgtcctgatggcagcgaccaggctggactcgggctgtgcaggggcgaggggagcagggcggggtgacgcccggagagcggcctggagagcgcgtgcttcagaaggcgtgggcaccctgtcccctttgcagatggggatgcaggccctggtggcggtggaggggagatgggggcagggacgttgccgggcagaggaagctggaagtttggctgctgtaactgactgggaagcttaaaataacagacaatcatctctcacatttatggggactgggaagtccaagaccaagttgccatctggggagggcctgttcctcacagcgccttccagctcaggcctcgtttataagggcactcaagccttccacgacaangggtcctcatgacttactcacctcggaaagccccacccccaagaccatcacattgtgggtgatggcagagcataaggtgccttccccacatgctcgggttggcccagcgtctcacgctagcagctacgtggaatagttattttttctggagaactctgggacccctctgatgtcttggagcacccacacaggccgttcactgtgcacgctgtgaggctgtcgtcttggagcacccacacaggccgttcactgtgcacgtggtgaggctgtcctctggggagttctgctgttgtatgggttctgtctgtgtcaatgtcccagcgggaacgcagggcacactagcgtcatccccagagggcttggtaaggggactgtttgcagagacataggcagagggctggaaaactaccaaaaaagtgcagtgttctggacctaataatagcagagctattctcaccctggtctgaaggcaggaggggaggagcagttaatggattctggaagtcaggttgcacagagtcaccttgaaagatgccatgaccttcaccgagggccagacagagactaagatgaccccataggagaataagacctagacctcatcctcctgcctcctgccagtccctgccaggggtcgccaatggcaaaacaggactggaagccagaggccatggaagcccatggatgaagtccacaggccagcctccccgagagcagcctggacggtccgcaggagacgtctcctgtcttaggcgtcccacgccgngtgctcctgttcagccctgccgaggtggaagcttggagtggctcacggtggatgcattgacgctgcagacgccagcaagtgctacaaaccagagctggcctttaactcagactgatggagaaggtgttaataatgcagattagacttaaaagtgttgaagccattgcactgtgaacagcaaaaaaattgaagaactcttctggcatttaaaaacaattactcagttcagcagagaagtcactgacaaacgagatcacactgactgctttgtcgttttggttttgtcttactcattaatgcaaataagaacattcactagcatctgtgtcgggcctaccctccctggtcaaatacagctacagtctccctgcagatacgagttttccagaaatgagccgatgttttctgcgagaatcaattggtcatatacaatttacaaaaatgagtactgtatactatatttgtaaactgtacactgcagatgctttatttcactgaaatttataatacacttatccatgtatatgcatgcatgcatttttgttcctgagatccagctgtgaaatgtttaccagcacataaattaccagcacatgctcttttttgttaacctactaggtaaaatcttcatttattacatcaaattcttgtagtttttgtattgcaattatgcagatattgattatcgcagtattactgcaattatacagataccacaatttcagatattgatcagcgtgttcagttggtttctaaggaggtttacttacctcatggtacacctagtttgcatagtttgattatatttaactcttatgctaattgggggaagtcattgatttattggacagatgcacctgtggtcttccctgagcacatcctggccaaggatgctgcccccaggagatttgagaagtcctgtaaggatcatatcagtattttcaaatacttatagaaaagccagagggattgacccagaattaccaatataagcttgaccctgagataacaatgccattttatgtttgcatgcataaaaccaatgcaagaggctgatgactccagatcccttatataagccaataaaaagtagtttcattttttatttcattta

SEQ ID NO: 69431 - DNA, 519 bp, Homo sapiens
gactgcaagtgtggaccaccatgtctggctaatgttttttatttttagcagaaatgaggtcttgctatgttgccaaggctggtcttgaactcctgagctcaagcgagccttctgccttggccttccaaagggctgggattagagggctgagccaccacacttggccaaccatattttattttttatatttttattttatttgatccttgttctgaaaccataaagtgagtttaacatttctggctgggcacagtggctcatgcctgtaattctagcactttgggagaccaaggcaggaggatgccttgagcccaggagtttgagaccatcctggacaacataatgagaaaagaaaatacaaaaattaaggggtgtggtgacacatgcctgtagtctcaactatttgggaggctgaggcgggaggactgcttgagcccgagaggttgaggctacagtgagccatgtttacgccattgcagtccagcctgggcgacagagtgaaaccctgtctcaaaaaaa

SEQ ID NO: 69432 - DNA, 438 bp, Homo sapiens
cgtgaaagtcttgtctttcagacaactcattctggcagtagtgtagaaaaggaattgcaggggattcaatggaagcagaaagctctgttagaagtctatgaggataagtcctggccagtaggtgtgaggccctgaactaaaagcagaggcagtggaatagataggaaagaggttaaaggtggatattgtggagtaagtcaatgattggtgttccagttatctatctatctatgccctaaaacattggcatatacgcaagattgcagaagacaaggacaacatagaaaaatttattgtatttctgtacagaagcaatgagcagactgaaaatgaaattaaggaagtgattccatttataataacaccaaaaagaaataggaataaattgaacaaaagcagtgcaaaacttatactttggaaactacaaaacatagttga

SEQ ID NO: 69433 - DNA, 512 bp, Homo sapiens
gaaaagagtgactaattaacatatagatgtggagtctcttgaattcttcatcaaaagacctccatcatgaactctgttttgcaaatagccagtcagtggaatcctgtgtttcttatgaagtgccatagctacgtgattataataatttaatggtctacattgtcttgaactctaaaaatgtgacatgcaactctccttcctactgaaatgtttctttttctttactaacgtactttgagcatgccaacaaatgcctatgtgctctttgtgcaaaacctattaaactaataccattgccctttcaacttagcttgtgtttaagcagaaatcatagaacataattacaaatgtaatttgatgagcatttgattctgctttcttcactttgtcctgttggcacattttcataattttgtttctaggcaatttttaagtgcattttgagatcttaaattttctataccaaagtcaatgccagtaattttaagaaaaaaagaaagtgaaatatttta

SEQ ID NO: 69434 - DNA, 800 bp, Homo sapiens
agctgtgcgtggaaatggccggctcaagcagccgagacagagcagagtgtgagagagctaatggaagtaagctgctgaagaaaccgtattcacctgcctatggcccgtgagtgttcttgaagctatctggcgttcatccacccactcccctcggacctcagcatgggctggaacctcaccctagacctaacagatgctctcatgagcactcttcaaactcagaaatttcccttacgtcatcacgagccgaagatttctaattaaattcctcccgagttcattctgcttcctgccacactgtgaaaaaggtgcctttcttctggtttgccttctaccatgactgcaagtttcctgaggcctccccagccatgcagaactaacatttggataccacttacctctgagacagttcttttggaaattataaatatatttctttccggggatcaaaagaatccacatcaacatgaaagatgaagtgttgaatctgaattcacagctgctttatgcaatctggaaaaaggtcaagctggagtgcagtggcccaatcctggctcactgcaacctctgcctcctgggctcaaggcatccttccacctcagcctcccaagtagctgggactacaggagagaagacaatgaggtcagctagaatgatggattgtcatcactggggcacgggaaaggggttgagcaagtcaatgtatgttttccagagcctacagaatgtgtctgattctctgaagtatattttttctaaatgccaggtgagtatgcaatgctaatgtgaggtagagatta

SEQ ID NO: 69435 - DNA, 449 bp, Homo sapiens
agctgtgcgtggaaatggccggctcaagcagccgagacagagcagagtgtgagagagctaatggaagtaagctgctgaagaaaccgtattcacctgcctatggcccgtgagtgttcttgaagctatctggcgttcatccacccactcccctcggacctcagcatgggctggaacctcaccctagacctaacagatgctctcatgagcactcttcaaactcagaaatttcccttacgtcatcacgagccgaagatttctaattaaagtatgtcaagatgaagtggacttaattgacatctgccttttaaagtataattcgttcttttcttgaaactcggatctctaagtagtagaatatttagtaaatataactcccatccttattctaggcgatttgggaaataaaatattagatgtgaagcttaatacaacgtttgaaaatattataa

SEQ ID NO: 69436 - DNA, 553 bp, Homo sapiens
gccaagaatcaggaatacctaaacctgagtgaggaaaggccatcagcagatctcaacagcaaggtgactcagatagtggaattatagggcaaggatttgaaaacagctatcataaaaatgcttcataaaattacagatacacatgaaacaaatgaaaaatagtctcagcaagaactggaaagtttcagcaaaaacctagaagatagaagaatcaaatgaaaattttagaactatacaatagccaataaaaaagtcactgaatgggctcatcagcagaatagagatgacaggagaaagaatcagtgaacttgaaggtagaacaatagaaattacctgacaaagagcagacttaaaagaaaaagtaatgaacaaaatgaacagagtttctgggacctgtgggactataacaaaagatgtgacattcacatcattgtagtaacaggagatgagtgtggggttgaaaaagtgtttgaagaagtaatggctgcatttttgtcatatttggcaaaagacataaacctacattttcagtgaaccccaagaggataaactc

SEQ ID NO: 69437 - DNA, 2824 bp, Homo sapiens
gggttccagatcaatagctaacgatcctggcgcagggctgaatggagttaaggaactttaacactttaattaggctgccaccgaaaataaattcctacacatctgtcaattcttacttgagcggtaatctcctcttccagctagacctgccacttcctgctcactgcagcagctgcttccattcagccaaggcttccttcttcagtgcccctcctactacatttctctggggcttcccatttcctgggtcatttaagacagggagctgagtttggtcttgtttctgctgtctactgctggacttctataaaaggacaggaactggactcttaataaaatgatctcttaggccctaccagttctaatactgtaattttccctctatcttctgtgtgggtgtttctttttgttggcttttcatactctcctacctgctgattgagccatccattttctccttcattgactggctgcttgtcctgcttcctctgtcctatgtcctcccttccctgatgccacacctctttaagctgactctccccccatcctacacagggaaggctcctgtcacccccttagctgagccacccacccctgagaaagatgcccagaacaagacagaacaattgggtgagttttccctcccttccccccagtcctcctaccttctgagacgctcacgggaccttgcagtaatccaggagcccagcaatgtctgtgctcaaggagcaaaactgattaaagaaagggctcatcagggggaagggaggctgagccacgagaggctaggcacttccgccctctttgagaactcagacctgaccatcctactgacccggagtcagcccttgccaagcctcacctatctactgagtttcctgccctttctctagtgcccaactccctaccctggaagctctctgctacaaatcatcttgagggctgtcagggttccttaatctcctcttctttcatcctcagcttcagaagagacagaaaacaagactggcccttccagagacagtgccaaccagaccacggtcagaattggggtaactgggaagagctgaagtgggggcctggctttactgagatctgctcatattctaaaggcagacgtaattttgtcatgctttgacttatttcactcagaatagcacagttaagaaattccacccagatccagttccacatgttcagcactttcgggggcagagctggcccagcagggtcaagcacagagggagatgataggagggagacagcaggaacttgagggaaagatgaataaaggaattgtgctgagagtaggaaagagtgggggtacatgctggaaggaggggaggagaaaggcaaaagcaaacaaccagctactgcccagctctttatcccttagttaggagcagaaagacaagacaccggtgttcctaccctacaaaacgccctgagcctggatggaactgtcctggcatcctcttactaagggtaggggcaccaaccaaatgattcacactgacagcatgtgccacaaatctctaaatccccaggactcagacctaggcagcacccaggaatggcagctctgtgttctgaggggattcccagcctctggtttgagatgccatcctgtgcctcacagctctccaaactggactacaatatgtaacatttattgttattgcaatacgcagtgttactgcattactgcaagctgaagtaatgccttatgtcctcagcatcttttcttcctaactcctgctcccgccaacagacctcttccagatgtctgctccaggggctaggtgcgttaagatgagcatctggatccccttcctttacagtcatcccctccctgacacacaggcctgtgccactggtgccagcctggatgcaggctgggtaggtctggcagtcaggtgatggtggggcctctggcagcctcacccctctggaagtgtggctgagaatgtgctgagagggctgggccagaattttcctgggccactgggggagctgtggtgtttattcacattaggaaaaagaagaaggaaaaagaaagatggaaaataaggtgggagctgctgagcctgagggaggatgagctggcttctgagcagacaggtagggcccctttccaggtgatggttcacagaggcagagtgggcagggacaagggagcctctgggtccagaaaatgcccagaggaaatggaaccatttcacagagaagacacgacaggataggataggtaagagaagaaaactaaatccaaggtgggggcagtaggtacagagccatctgttagctggagagttgaggcaggcagcaaagactgggaaagacacaccaagaaaaggcagagaggccaggatggtggaagagggccagacaaagaaggagtgcaaggtagcggcctaagctaggcctttgtcccaatccaagggaaagtggggaggagccagctctcaggactgtggctggaggctgggtctgctataatgccttcctatctggctagttcctcttcaattaggagtgagaggccaagcgtggtggctcacgcctgtaatcccagcactttgggaagccaagatgagtagatcacctggcatcaggagttcaagaccaacctggccaatgtggcaaaaccctgtctccactaaaaaatacaaaaattagctgggcgtggttgcacacgcctgtaatcccagctgcttgggaggctgagggcaggagaattgcttgaacctggaaggcggaggttgcagtgagccgagatcacgtcactgcactccggcctgggtgacagagccagactccatct

SEQ ID NO: 69438 - DNA, 5428 bp, Homo sapiens
ggagcgagcgagtgcccagggtgaatcaatggaaaccccctcacgaagccggggaaacacttcagccgcagccaaatagcattgattattttccttcacttccctcaccgccgtgaatttatttatttatttttttccgtctccgtccctgacgccccggagcgagcgctggagggagggaggaggaggggaaaaaagaggaatcaacacatcggagaagtcccttccaagagccgccccctcccctccccgcctcgcgctgctcggtggccgcggttcgactcccgtccctgcttccagctgaggtggtactggctgtcacgctgacatgagcccccagcactcctccgtctaccatggccacccttaactcagcctctaccactggtaccaccccctcccctgggcacaatgccccgtccctgccttcggacaccttctcctccagcaccccctctgatcctgtcaccaaagatccccctgctgcctcctccacctctgagaacatgaggtcctcagagccagggggacagctcctggagtcgggctgtggcctcgtcccaccaaaggagattggggagccccaggaagggcctgactgtggtcacttcccaccaaatgacccaggggtggaaaaggacaaggagcaggaggaggaagaagaagggctccctcccatggacctaagcaaccacttattcttcacagctggaggtgaggcctacctagtggccaagctgtccctgccaggtggcagtgaactcctgttaccaaagggcttcccctggggtgaggcgggcatcaaggaagagcccagtctgcccttccttgcctacccacccccctcacacctcactgcccttcacatccaacatggctttgacccaatccaaggctttagctcttctgaccaaattctgtcccatgatacctcagcaccatctccggctgcctgtgaggaaaggcatggagctttctggagctaccagctggctccaaatccacccggagatcccaaagatggccccatggggaacagcgggggcaaccacgtggcggtcttctggctctgccttctgtgccgcctgggtttcagcaagccccaggcctttatggatcacacacagtctcatggggtgaagctaacccctgcccaatatcagggcctgtcaggtagcccagctgtactccaggagggagatgaaggctgcaaggccctcataagctttctggagccaaaactccctgctcgcccctcttctgacataccccttgacaacagcagcacagtgaacatggaggcgaatgtggcccagacagaggatggcccccctgaggcagaagtccaggcccttatcctcctggatgaagaagttatggccctcagcccaccctctccacccacagccacctgggaccccagcccaacccaagccaaagaatcgccagtagcagcaggcgaggcagggccagattggttccctgaggggcaagaagaggatggagggctctgccccccactcaaccaaagctcacccacctccaaggaggggggcactctccctgccccagtgggctcccccgaagaccccagtgacccaccccagccctatcgcctagctgatgactacaccccagcccctgcagccttccagggcctcagcctgtccagccacatgtccctgctccactcacgcaactcctgcaagacactcaagtgtcccaagtgcaactggcactacaagtaccagcagaccctggatgtgcacatgcaagagaagcaccctgagagcaacagtcactgcagctactgcagtgctgggggcgcccacccccgccttgctcgtggagagagctacaactgtggctacaaaccctaccgctgtgacgtctgcaactactctacaaccaccaaaggcaacctcagcatccatatgcagtctgacaagcacctggccaacctacagggcttccaggcgggccctggtgggcagggaagtccaacagaggcatcactcccaccctccgcgggagacaaagagcctaagaccaaatcatcctggcagtgcaaggtgtgcagctacgagacaaacatctcccgtaacctgcgcatccatatgacctctgagaagcacatgcagaatgtcctaatgctgcaccaggggctgccgctgggcctgccacctggattgatggggccaggccctcctcccccaccaggggctacccccactagcccccctgaactcttccagtactttgggccccaggccctagggcagcctcagactcccttggctggcccggggctgaggccagacaagcccctggaagcccagctacttctcaatggtttccaccacgtaggagcacctgcccgcaagttccccacatccgcccctggaagcctatcccctgatgcccacctgcctccaagtcagctcctgggttcctcatctgacagcctgcccacctcaccacccccagacgacagcctgtccctgaaggtgttccgctgcctagtgtgccaggccttcagcacagacagcctggagctgctgctctaccactgcagcataggccggagcctcccggaagctgaatggaaggaggtggctggtgacacccaccgctgcaagctttgctgctatggcacccagctcaaggccaacttccaactccacctcaagactgacaaacatgctcagaagtaccagctggcagcccacctgcgggaggggggtggagccatgggcaccccttccccagcatccctgggagatggggctccttatgggtctgtctccccactacacctgcgctgcaacatctgtgactttgagtccaacagcaaggagaagatgcagctgcatgccaggggtgcagcccacgaagaaaacagccaaatctataaaaggacaggaactggactcttaataaaatgatctcttaggccctaccagttctaatactgtaattttccctctatcttctgtgtgggtgtttctttttgttggcttttcatactctcctacctgctgattgagccatccattttctccttcattgactggctgcttgtcctgcttcctctgtcctatgtcctcccttccctgatgccacacctctttaagctgactctccccccatcctacacagggaaggctcctgtcacccccttagctgagccacccacccctgagaaagatgcccagaacaagacagaacaattgggtgagttttccctcccttccccccagtcctcctaccttctgagacgctcacgggaccttgcagtaatccaggagcccagcaatgtctgtgctcaaggagcaaaactgattaaagaaagggctcatcagggggaagggaggctgagccacgagaggctaggcacttccgccctctttgagaactcagacctgaccatcctactgacccggagtcagcccttgccaagcctcacctatctactgagtttcctgccctttctctagtgcccaactccctaccctggaagctctctgctacaaatcatcttgagggctgtcagggttccttaatctcctcttctttcatcctcagcttcagaagagacagaaaacaagactggcccttccagagacagtgccaaccagaccacggtcagaattggggtaactgggaagagctgaagtgggggcctggctttactgagatctgctcatattctaaaggcagacgtaattttgtcatgctttgacttatttcactcagaatagcacagttaagaaattccacccagatccagttccacatgttcagcactttcgggggcagagctggcccagcagggtcaagcacagagggagatgataggagggagacagcaggaacttgagggaaagatgaataaaggaattgtgctgagagtaggaaagagtgggggtacatgctggaaggaggggaggagaaaggcaaaagcaaacaaccagctactgcccagctctttatcccttagttaggagcagaaagacaagacaccggtgttcctaccctacaaaacgccctgagcctggatggaactgtcctggcatcctcttactaagggtaggggcaccaaccaaatgattcacactgacagcatgtgccacaaatctctaaatccccaggactcagacctaggcagcacccaggaatggcagctctgtgttctgaggggattcccagcctctggtttgagatgccatcctgtgcctcacagctctccaaactggactacaatatgtaacatttattgttattgcaatacgcagtgttactgcattactgcaagctgaagtaatgccttatgtcctcagcatcttttcttcctaactcctgctcccgccaacagacctcttccagatgtctgctccaggggctaggtgcgttaagatgagcatctggatccccttcctttacagtcatcccctccctgacacacaggcctgtgccactggtgccagcctggatgcaggctgggtaggtctggcagtcaggtgatggtggggcctctggcagcctcacccctctggaagtgtggctgagaatgtgctgagagggctgggccagaattttcctgggccactgggggagctgtggtgtttattcacattaggaaaaagaagaaggaaaaagaaagatggaaaataaggtgggagctgctgagcctgagggaggatgagctggcttctgagcagacaggtagggcccctttccaggtgatggttcacagaggcagagtgggcagggacaagggagcctctgggtccagaaaatgcccagaggaaatggaaccatttcacagagaagacacgacaggataggataggtaagagaagaaaactaaatccaaggtgggggcagtaggtacagagccatctgttagctggagagttgaggcaggcagcaaagactgggaaagacacaccaagaaaaggcagagaggccaggatggtggaagagggccagacaaagaaggagtgcaaggtagcggcctaagctaggcctttgtcccaatccaagggaaagtggggaggagccagctctcaggactgtggctggaggctgggtctgctataatgccttcctatctggctagttcctcttcaattaggagtgagaggccaagcgtggtggctcacgcctgtaatcccagcactttgggaagccaagatgagtagatcacctggcatcaggagttcaagaccaacctggccaatgtggcaaaaccctgtctccactaaaaaatacaaaaattagctgggcgtggttgcacacgcctgtaatcccagctgcttgggaggctgagggcaggagaattgcttgaacctggaaggcggaggttgcagtgagccgagatcacgtcactgcactccggcctgggtgacagagccagactccatct

SEQ ID NO: 69439 - DNA, 344 bp, Homo sapiens
gtaagcatgattctctctccagtgcaatactcactccttcaagtttgggccttgttcacctctatatccctagccaagaactcgagtaataatttcaataaatacatgaatttaaagtgaatgaccattcagtcatcagcccttaatttctacattatacaaattttattgtttcacttcaccaaaatttacagtagaagctacggaaagattatatgtatgagattcgcgttgcttctttcttctgaagatctccaagttgtgcacatgaaaaacatttatgcaaaattaatcttattcatgttcttgctaatctgcaaagtcggaactatcatcagtgttgg

SEQ ID NO: 69440 - DNA, 338 bp, Homo sapiens
ggcggattccctccagtttctcccgctggcgggttgcatctaaagtcgtccgagtcaacagccgtgactctgggtgatactagctctcattaaccgtccacagatttggggtgttatgtgactgaaaggaacgaggctgcaggaaagccacaagataacgatccgtttctgtgtgtcagctgtattcttcctcgagtatcttgtttgtgtacatgcttttatttgcattaaggttggtgcaaaagtaactgcggtttttgccatttggcaaaatactttggaatgctcttccttattccctggagatgttatctttcaagggtctgttgtcgttaacc

SEQ ID NO: 69441 - DNA, 381 bp, Homo sapiens
gtgggtactgtacttgaatatcaatccagcaatgttttcagtacagctttaaaataatcaaagagatacttcactgaaggatcatagacacttaagttttttcctataatcttatgaccttaaagcagaaaacactgtaaccacctgtcttagttggctaaggctgctataacaagattaaatatcacagattgggtggcttcaacaacggacatgtatttctcacagttctggaggctgggaagtccaagatgcctgcagattcactgtccggtgaggatcctcttcctgtctggtagacagctgccttcttaactgagtgctcatatagcctttcttctgtgtgtaagtttagagagaaagaaagtgatccctgtcttt

SEQ ID NO: 69442 - DNA, 1847 bp, Homo sapiens
  misc_feature (84)..(84): n is a, c, g, or t
  misc_feature (90)..(90): n is a, c, g, or t
  misc_feature (109)..(110): n is a, c, g, or t
  misc_feature (119)..(122): n is a, c, g, or t
  misc_feature (129)..(129): n is a, c, g, or t
  misc_feature (132)..(132): n is a, c, g, or t
  misc_feature (134)..(134): n is a, c, g, or t
  misc_feature (149)..(149): n is a, c, g, or t
  misc_feature (151)..(152): n is a, c, g, or t
  misc_feature (155)..(155): n is a, c, g, or t
  misc_feature (157)..(157): n is a, c, g, or t
  misc_feature (168)..(168): n is a, c, g, or t
  misc_feature (173)..(174): n is a, c, g, or t
  misc_feature (177)..(177): n is a, c, g, or t
  misc_feature (180)..(180): n is a, c, g, or t
  misc_feature (183)..(183): n is a, c, g, or t
  misc_feature (188)..(190): n is a, c, g, or t
  misc_feature (192)..(193): n is a, c, g, or t
  misc_feature (195)..(195): n is a, c, g, or t
  misc_feature (198)..(199): n is a, c, g, or t
  misc_feature (204)..(207): n is a, c, g, or t
  misc_feature (212)..(214): n is a, c, g, or t
  misc_feature (225)..(226): n is a, c, g, or t
  misc_feature (228)..(228): n is a, c, g, or t
  misc_feature (230)..(230): n is a, c, g, or t
  misc_feature (234)..(234): n is a, c, g, or t
  misc_feature (236)..(238): n is a, c, g, or t
  misc_feature (243)..(243): n is a, c, g, or t
  misc_feature (255)..(255): n is a, c, g, or t
  misc_feature (257)..(257): n is a, c, g, or t
  misc_feature (263)..(264): n is a, c, g, or t
  misc_feature (271)..(272): n is a, c, g, or t
  misc_feature (277)..(277): n is a, c, g, or t
  misc_feature (294)..(294): n is a, c, g, or t
  misc_feature (307)..(307): n is a, c, g, or t
  misc_feature (317)..(317): n is a, c, g, or t
  misc_feature (333)..(333): n is a, c, g, or t
  misc_feature (342)..(342): n is a, c, g, or t
  misc_feature (349)..(349): n is a, c, g, or t
  misc_feature (1234)..(1234): n is a, c, g, or t
  misc_feature (1492)..(1492): n is a, c, g, or t
atgtcgctcatggtcgtcagcatggcgtgtgttgggttgttcttggtccagagggccggtccacacatgggtggtcaggacaancccttnctgtctgcctggcccagcnntgtggtgcnnnnaggacangtnantcttcggtgtcactntnntcntnggtttaacaanttcannctntanaangaagnnngnntnccnntcccnnnntccannncagaatattcnngnanagcntnnncatgngccctgtgaccncngcacanncaggganntacanatgtcggggttcacacncacactcccccantgggtggtcngcacccagcaaccccntggtgatcntggtcanaggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcncccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcncttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctcaaaaaaaa

SEQ ID NO: 69443 - DNA, 998 bp, Homo sapiens
agctggggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaatgctgttgtaattgaccaagaccttgggggaacgaaccgttgaccgggaggcctctgattaaccagaccctcaggaaggggactatgcccgtggattcctggttttccccaagaaattctcccttttaggccgagaaccaa

SEQ ID NO: 69444 - DNA, 1603 bp, Homo sapiens
  misc_feature (990)..(990): n is a, c, g, or t
  misc_feature (1248)..(1248): n is a, c, g, or t
agctggggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggtctatatgagaaaccttctctctcagcccagccgggccccacggttctggcaggagagagcgtgaccttgtcctgcagctcccggagctcctatgacatgtaccatctatccagggagggggaggcccatgaacgtaggttctctgcagggcccaaggtcaacggaacattccaggccgactttcctctgggccctgccacccacggaggaacctacagatgcttcggctctttccgtgactctccatacgagtggtcaaactcgagtgacccactgcttgtttctgtcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcncccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcncttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctcaaaaaaaa

SEQ ID NO: 69445 - DNA, 1309 bp, Homo sapiens
  misc_feature (696)..(696): n is a, c, g, or t
  misc_feature (954)..(954): n is a, c, g, or t
agctggggcgcggccgcctgtctgcacagacagcaccatgtcgctcatggtcgtcagcatggtgtgtgttgggttcttcttgctgcagggggcctggccacatgagggagtccacagaaaaccttccctcctggcccacccaggtcccctggtgaaatcagaagagacagtcatcctgcaatgttggtcagatgtcaggtttcagcacttccttctgcacagagaagggaagtttaaggacactttgcacctcattggagagcaccatgatggggtctccaaggccaacttctccatcggtcccatgatgcaagaccttgcagggacctacagatgctacggttctgttactcactccccctatcagttgtcagctcccagtgaccctctggacatcgtcatcacaggaaacccttcaaatagttggccttcacccactgaaccaagctccgaaaccggtaaccccagacacctgcatgttctgattgggacctcagtggtcatcatcctcttcatcctcctcctcttctttctccttcatcgctggtgctgcaacaaaaaaaatgctgttgtaatggaccaagagcctgcagggaacagaacagtgaacagggaggactctgatgaacaagaccctcaggaggtgacatatgcacagttgaatcactgcgttttcacacagagaaaaatcactcncccttctcagaggcccaagacacccccaacagatatcatcgtgtacacggaacttccaaatgctgagccctgatccaaagttgtctcctgcccatgagcaccacagtcaggccttgaggggatcttctagggagacaacagccctgtctcaaaactgggttgccagctccaatgtaccagcagctggaatctgaaggcgtgagtctgcatcttagggcatcgctcttcctcacaccacaaatctgaacgtgcctctcncttgcttacaaatgtctaaggtccccactgcctgctggagagaaaacacactcctttgcttagcccacaattctccatttcacttgacccctgcccacctctccaacctaactggcttacttcctagtctacttgaggctgcaatcacactgaggaactcacaattccaaacatacaagaggctccctcttaacacggcacttagacacgtgctgttccaccttccctcatgctgttccacctcccctcagactagctttcagccttctgtcagcagtaaaacttatatattttttaaaataatttcaatgtagttttccctccttcaaataaacatgtctgccctcaaaaaaaa

SEQ ID NO: 69446 - DNA, 2996 bp, Homo sapiens
  misc_feature (36)..(36): n is a, c, g, or t
  misc_feature (191)..(191): n is a, c, g, or t
  misc_feature (333)..(333): n is a, c, g, or t
  misc_feature (345)..(345): n is a, c, g, or t
  misc_feature (354)..(354): n is a, c, g, or t
  misc_feature (363)..(363): n is a, c, g, or t
  misc_feature (471)..(471): n is a, c, g, or t
  misc_feature (534)..(534): n is a, c, g, or t
  misc_feature (733)..(733): n is a, c, g, or t
  misc_feature (867)..(867): n is a, c, g, or t
  misc_feature (1026)..(1026): n is a, c, g, or t
  misc_feature (1107)..(1107): n is a, c, g, or t
  misc_feature (1397)..(1397): n is a, c, g, or t
  misc_feature (1954)..(1954): n is a, c, g, or t
  misc_feature (2062)..(2062): n is a, c, g, or t
  misc_feature (2422)..(2422): n is a, c, g, or t
  misc_feature (2558)..(2558): n is a, c, g, or t
  misc_feature (2631)..(2631): n is a, c, g, or t
cacttatatatcttaattaaaataaatcaacccatntaaattgtttatttctattgtctttctcagtataatgcacaagatacctttctatctctatatgtatttgtcattttcatgtctgtccctacatgaattgactctatttttctattacatagatatgtgatgttactacaatatatgttaactanaaatggatgatgtaaccttttaaaattatgaccatcacagtgaaaattatgtctctaaaacccaatgaccacagggacattccagtttttagaaaaatatcaggggcttaggtattttcagattaaattttgaaaaatagantatctttccatngatttatgngggcaaatntcccatttgttcacattaaatcttaatggcatattgcctaaatcttcctcagaaaagcttagccaaattgcctaggatgtttcctttctcccatattaccatcactgnataccatcatatttctaataattttaattttggaacatgaaaatggtatttcaatttaaatgngtatgtttttctatttgcaaagagattaaacatctcttcaagtttttaaactatatgcagcccttcttttctgctatacctgttcatttcctcaagctatttttccatcagacagttttatgttttcttattgatttgaagcttctattaaagtattgtatacacatgggtaaatgcacataagtttaaagcttagtgngttttaaaatactatgatcatccagaataagaaaatgtaatagtcacacacctgatttccacccatccctcctaacataacactattctaacttttatcagtaaggaatcaaatagtgtgtgtagtgttttganccgcatttttttgcttaatattacatttgtgagactaattgattatatgacctgcaaatgaaactatttacatttatttctctaatattttattaggtgatcatattacaacttatttgtttactgtactctttataagtattttagtccacttttggnccacagtttggggttattttggtgttattctgaaaagtgttttcatgagtacacattttttagctatatatatgcatgccnttctggagaaaccatctttacaagtagaattttggggcctactacatatctttatccaaattatttgaactaagttatgccaataacatcaatttgagtgttctaattagtcaacattctcatcaatactttgcattttctcttcaacttagaattctaaaacattcctttcaaattcaggattctgaatgacaagtatttacatctcattgtggtttgaattattttttcagataaccaatataaataaaaaccttttaataagttcattggttatttgaatattttanttttgaagtgtctaaaatattttctttttaatccagtccagttatttttctgtggtttgcttcttgttgtcttattgagttcattgcctttttaatattcttttccagttaacatttccccctcattgatctgaaatgttttcattatataccacctttccatatctgtcagtgtcttgattttctatatgatcttcatctatctgtatttataactcattttaatcatagaagctttaagaattgcttaatattttgtattgactccaaattccattgattttataggatatttctagctattcttgcttctttattcctccaagtaaatttgtctatttttctaaatctggacaaagaaattctagaaaatatcgttttgttatgacatagaagatataagtttatttaaagaactggcacatttatgattttaaggctttttcaagagcatggaatttctttccccgtgctcaagtccaaatttgtgccattcagaagtgttttctagttttttttatatataggttttaaacatttctggttaagtttatgcnctcacattttattttagtttggttaatgacgttttacatgtgtgagttcctcaattatttcttttaaatgttctgattcaataggaacactctccttagtatccttancagaaatgattcttgtttatagaattgctaaataagtaaagaaattttgagttaaatcatggcaaggagttataattatactaagcttttttgttcctagagattttggctcactcatatggtaatctatatgaaaatttttctgtgatatctaataggagaaagatcctcaatgatagaatagtgtttcttcctagctgattcatacatctttctctgccaacattttgtttgttgaagtgttccccaacatatgactcattgcttactaaatccctattgagcagccaaagccctggtgactaattatgtcattaatttgggaaagtcagagacaataagactgtcagttgaaacttngtaggaggtaaaaaagtcactgctgtcagctgcaaagatccttaaaatggtctttaataaagtcaaattttgtgacaataattattgcatcaaagtcggggaaatacctcttagatcaaataagatacattgaaangccaaaaattatttttatctcactttgtattctcataaggtctatccactgttacttggatatgagacttaanaaatggaaaagaagacaggggtactatcacactgtattttcctatggcctaatgaccacaatggttgatgaactgcagtaaagtttctataatattttccatctattcatttgctcaatcaccttgtaatggttatgttggttaattccagtctctcatgtgtaagcaacaaaatgagacttaatttgaaatatccagtatttttctattcttacaaataattttcaggatcaatgcgttgaggattaggaatggcaatgtgtattactactttgataccaactatatccgatctaatgttggaatttgtttgacaaagtgttgtgtatttgaaaacaggcagcactgaataaaaagaatatggg

SEQ ID NO: 69447 - DNA, 1545 bp, Homo sapiens
tccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaagccttcctgtgcatcggtggatctgcagggagacagctccttacaggtggagatttctgacgcagtgagtgagcgggacaaggtgaaattcactgttcaaacaaagagctgcctccctcacttcgcccagaccgagttctcagtcgtgcggcagcacgaggagttcatctggctgcatgatgcctacgtggagaatgaggagtacgccggcctcatcatccccccagcccctccgaggccagactttgaggcttcgagggaaaagctacagaaattgggcgagggggacagctctgtcactcgggaagagtttgccaagatgaagcaggagctggaagcggagtacctggccatctttaagaagacagttgcgatgcacgaagtctttctgcagcgcctggcggcccaccccaccctgcgtcgagaccacaacttctttgtgtttttggaatatggacaggatctgagtgtccgggggaagaacaggaaggagctcctcggagggtttctgaggaatattgtgaagtccgcggatgaagccctcatcacgggcatgtcagggctcaaggaggtggatgacttctttgagcatgagaggaccttcctgttggagtatcacacccgtatccgagaatgcctgcctgcgggccgaccggtcatgcgcgcccacaagtgcctggcagacgattatatccctatctcagctgcgctgagcagtctgggaacacaggaagtcaaccagctaaggacgtgaggactccccccacccctaccctctccctgtgcctgtaataccatgtcttcccatgaggggtcactctgtagatgtctactgtcagctctaggtgggaggtgtaggctctcctgttgggggatggtgttgggaaggaaaggggagagggagattcccaaggagaggctgagacagagaggctttgagctgttcctcagccccctaccctaactccctccctactgcttcctaggagcttcctcaaattggcagagctctttgaacggctgagggtgagtactgccttctgtgctcaaaggctttcctggtgagctttgcagggaagatgagtcctggcagagggaagagctccaggatcatcttgggttcagtgataacttgggcccagtggcaagttgggcttacactccagactagtttaacaaaaggtggggtgaagacaaggatccagcttcgtgtgtgtgttggggggtgcaggggcatgcacatgtatgcacgtgtgcagcagcggagggttgggaggcacaagggtgtgcccaaacctctggcaggctgcacccagctgccagcacactgcccgggcacacatgttccccactcttccctaagaaagtcactggagtg

SEQ ID NO: 69448 - DNA, 1712 bp, Homo sapiens
tccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaagccttcctgtgcatcggtggatctgcagggagacagctccttacaggtggagatttctgacgcagtgagtgagcgggacaaggtgaaattcactgttcaaacaaagagctgcctccctcacttcgcccagaccgagttctcagtcgtgcggcagcacgaggagttcatctggctgcatgatgcctacgtggagaatgaggagtacgccggcctcatcatccccccagcccctccgaggccagactttgaggcttcgagggaaaagctacagaaattgggcgagggggacagctctgtcactcgggaagagtttgccaagatgaagcaggagctggaagcggagtacctggccatctttaagaagacagttgcgatgcacgaagtctttctgcagcgcctggcggcccaccccaccctgcgtcgagaccacaacttctttgtgtttttggaatatggacaggatctgagtgtccgggggaagaacaggaaggagctcctcggagggtttctgaggaatattgtgaagtccgcggatgaagccctcatcacgggcatgtcagggctcaaggaggtggatgacttctttgagcatgagaggaccttcctgttggagtatcacacccgtatccgagaatgcctgcctgcgggccgaccggtcatgcgcgcccacaagtgtacgcagggcccaaggggtcctggatccccctgcccctctccccagcggttcaactccttgggggagagaagagagcagggcgtgccttgttgtttgtctgtggccacaagcaccaaggcttgacatgcagatgtaggggctctgatgggggctgttccccaacaggcctggcagacgattatatccctatctcagctgcgctgagcagtctgggaacacaggaagtcaaccagctaaggacgtgaggactccccccacccctaccctctccctgtgcctgtaataccatgtcttcccatgaggggtcactctgtagatgtctactgtcagctctaggtgggaggtgtaggctctcctgttgggggatggtgttgggaaggaaaggggagagggagattcccaaggagaggctgagacagagaggctttgagctgttcctcagccccctaccctaactccctccctactgcttcctaggagcttcctcaaattggcagagctctttgaacggctgagggtgagtactgccttctgtgctcaaaggctttcctggtgagctttgcagggaagatgagtcctggcagagggaagagctccaggatcatcttgggttcagtgataacttgggcccagtggcaagttgggcttacactccagactagtttaacaaaaggtggggtgaagacaaggatccagcttcgtgtgtgtgttggggggtgcaggggcatgcacatgtatgcacgtgtgcagcagcggagggttgggaggcacaagggtgtgcccaaacctctggcaggctgcacccagctgccagcacactgcccgggcacacatgttccccactcttccctaagaaagtcactggagtg

SEQ ID NO: 69449 - DNA, 1831 bp, Homo sapiens
tccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaagccttcctgtgcatcggtggatctgcagggagacagctccttacaggtggagatttctgacgcagtgagtgagcgggacaaggtgaaattcactgttcaaacaaagagctgcctccctcacttcgcccagaccgagttctcagtcgtgcggcagcacgaggagttcatctggctgcatgatgcctacgtggagaatgaggagtacgccggcctcatcgtgaggaggggctgggcaggggctgggagggacaggcagagcacttgggtgaggaccaaaggctgtgatggccgtctcggcagtgagaggcctcccagctccgtccctcctttgagcagatccccccagcccctccgaggccagactttgaggcttcgagggaaaagctacagaaattgggcgagggggacagctctgtcactcgggaagagtttgccaagatgaagcaggagctggaagcggagtacctggccatctttaagaagacagttgcgatgcacgaagtctttctgcagcgcctggcggcccaccccaccctgcgtcgagaccacaacttctttgtgtttttggaatatggacaggatctgagtgtccgggggaagaacaggaaggagctcctcggagggtttctgaggaatattgtgaagtccgcggatgaagccctcatcacgggcatgtcagggctcaaggaggtggatgacttctttgagcatgagaggaccttcctgttggagtatcacacccgtatccgagaatgcctgcctgcgggccgaccggtcatgcgcgcccacaagtgtacgcagggcccaaggggtcctggatccccctgcccctctccccagcggttcaactccttgggggagagaagagagcagggcgtgccttgttgtttgtctgtggccacaagcaccaaggcttgacatgcagatgtaggggctctgatgggggctgttccccaacaggcctggcagacgattatatccctatctcagctgcgctgagcagtctgggaacacaggaagtcaaccagctaaggacgtgaggactccccccacccctaccctctccctgtgcctgtaataccatgtcttcccatgaggggtcactctgtagatgtctactgtcagctctaggtgggaggtgtaggctctcctgttgggggatggtgttgggaaggaaaggggagagggagattcccaaggagaggctgagacagagaggctttgagctgttcctcagccccctaccctaactccctccctactgcttcctaggagcttcctcaaattggcagagctctttgaacggctgagggtgagtactgccttctgtgctcaaaggctttcctggtgagctttgcagggaagatgagtcctggcagagggaagagctccaggatcatcttgggttcagtgataacttgggcccagtggcaagttgggcttacactccagactagtttaacaaaaggtggggtgaagacaaggatccagcttcgtgtgtgtgttggggggtgcaggggcatgcacatgtatgcacgtgtgcagcagcggagggttgggaggcacaagggtgtgcccaaacctctggcaggctgcacccagctgccagcacactgcccgggcacacatgttccccactcttccctaagaaagtcactggagtg

SEQ ID NO: 69450 - DNA, 1990 bp, Homo sapiens
tccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaagccttcctgtgcatcggtggatctgcagggagacagctccttacaggtggagatttctgacgcagtgagtgagcgggacaaggtgaaattcactgttcaaacaaagagctgcctccctcacttcgcccagaccgagttctcagtcgtgcggcagcacgaggagttcatctggctgcatgatgcctacgtggagaatgaggagtacgccggcctcatcgtgaggaggggctgggcaggggctgggagggacaggcagagcacttgggtgaggaccaaaggctgtgatggccgtctcggcagtgagaggcctcccagctccgtccctcctttgagcagatccccccagcccctccgaggccagactttgaggcttcgagggaaaagctacagaaattgggcgagggggacagctctgtcactcgggaagagtttgccaagatgaagcaggagctggaagcgtgagtgccccctcctttccctgccatccccagagtccagatgtcttccccagctatctccccatgaatgtttagcaaccctgacctctgaccccagaaagggggcaggcaggatgatgggggctgaggagggccggtgagctgctgccactctcgcagggagtacctggccatctttaagaagacagttgcgatgcacgaagtctttctgcagcgcctggcggcccaccccaccctgcgtcgagaccacaacttctttgtgtttttggaatatggacaggatctgagtgtccgggggaagaacaggaaggagctcctcggagggtttctgaggaatattgtgaagtccgcggatgaagccctcatcacgggcatgtcagggctcaaggaggtggatgacttctttgagcatgagaggaccttcctgttggagtatcacacccgtatccgagaatgcctgcctgcgggccgaccggtcatgcgcgcccacaagtgtacgcagggcccaaggggtcctggatccccctgcccctctccccagcggttcaactccttgggggagagaagagagcagggcgtgccttgttgtttgtctgtggccacaagcaccaaggcttgacatgcagatgtaggggctctgatgggggctgttccccaacaggcctggcagacgattatatccctatctcagctgcgctgagcagtctgggaacacaggaagtcaaccagctaaggacgtgaggactccccccacccctaccctctccctgtgcctgtaataccatgtcttcccatgaggggtcactctgtagatgtctactgtcagctctaggtgggaggtgtaggctctcctgttgggggatggtgttgggaaggaaaggggagagggagattcccaaggagaggctgagacagagaggctttgagctgttcctcagccccctaccctaactccctccctactgcttcctaggagcttcctcaaattggcagagctctttgaacggctgagggtgagtactgccttctgtgctcaaaggctttcctggtgagctttgcagggaagatgagtcctggcagagggaagagctccaggatcatcttgggttcagtgataacttgggcccagtggcaagttgggcttacactccagactagtttaacaaaaggtggggtgaagacaaggatccagcttcgtgtgtgtgttggggggtgcaggggcatgcacatgtatgcacgtgtgcagcagcggagggttgggaggcacaagggtgtgcccaaacctctggcaggctgcacccagctgccagcacactgcccgggcacacatgttccccactcttccctaagaaagtcactggagtg

SEQ ID NO: 69451 - DNA, 1962 bp, Homo sapiens
tccttggccgggcgggggagagcgtccccgtcagctgagagcatcctcactcggtcagttcctcgggcgagttacggggacgacctgcgggagcacgcgggcagtggccggacgctgaagcccaggagagcgatggagacccttcctgtgcatcggtggatctgcagggagacagctccttacaggtggagatttctgacgcagtgagtgagcgggacaaggtgaaattcactgttcaaacaaagagctgcctccctcacttcgcccagaccgagttctcagtcgtgcggcagcacgaggagttcatctggctgcatgatgcctacgtggagaatgaggagtacgccggcctcatcgtgaggaggggctgggcaggggctgggagggacaggcagagcacttgggtgaggaccaaaggctgtgatggccgtctcggcagtgagaggcctcccagctccgtccctcctttgagcagatccccccagcccctccgaggccagactttgaggcttcgagggaaaagctacagaaattgggcgagggggacagctctgtcactcgggaagagtttgccaagatgaagcaggagctggaagcgtgagtgccccctcctttccctgccatccccagagtccagatgtcttccccagctatctccccatgaatgtttagcaaccctgacctctgaccccagaaagggggcaggcaggatgatgggggctgaggagggccggtgagctgctgccactctcgcagggagtacctggccatctttaagaagacagttgcgatgcacgaagtctttctgcagcgcctggcggcccaccccaccctgcgtcgagaccacaacttctttgtgtttttggaatatggacaggatctgagtgtccgggggaagaacaggaaggagctcctcggagggtttctgaggaatattgtgaagtccgcggatgaagccctcatcacgggcatgtcagggctcaaggaggtggatgacttctttgagcatgagaggaccttcctgttggagtatcacacccgtatccgagaatgcctgcctgcgggccgaccggtcatgcgcgcccacaagtgtacgcagggcccaaggggtcctggatccccctgcccctctccccagcggttcaactccttgggggagagaagagagcagggcgtgccttgttgtttgtctgtggccacaagcaccaaggcttgacatgcagatgtaggggctctgatgggggctgttccccaacaggcctggcagacgattatatccctatctcagctgcgctgagcagtctgggaacacaggaagtcaaccagctaaggacgtgaggactccccccacccctaccctctccctgtgcctgtaataccatgtcttcccatgaggggtcactctgtagatgtctactgtcagctctaggtgggaggtgtaggctctcctgttgggggatggtgttgggaaggaaaggggagagggagattcccaaggagaggctgagacagagaggctttgagctgttcctcagccccctaccctaactccctccctactgcttcctaggagcttcctcaaattggcagagctctttgaacggctgagggtgagtactgccttctgtgctcaaaggctttcctggtgagctttgcagggaagatgagtcctggcagagggaagagctccaggatcatcttgggttcagtgataacttgggcccagtggcaagttgggcttacactccagactagtttaacaaaaggtggggtgaagacaaggatccagcttcgtgtgtgtgttggggggtgcaggggcatgcacatgtatgcacgtgtgcagcagcggagggttgggaggcacaagggtgtgcccaaacctctggcaggctgcacccagctgccagcacactgcccgggcacacatgttccccactcttccctaagaaagtcactggagtg

SEQ ID NO: 69452 - DNA, 575 bp, Homo sapiens
tccttggccgggcgggggagagcgtccccgtcagctgagagcatcctcactcggtcagttcctcgggcgagttacggggacgacctgcgggagcacgcgggcagtggccggacgctgaagcccaggagagcgatggagacgtatgcggaggttgggaaggagggcaaggtagagaaaggatgaagacccccaccccagcctcccctcactccatgaaagcccgtgatgcccaatcatgcggtggtctgcctctgtgtgtttctgtgtgtgtctgtgtgtgtatagtctgcatgtgtctgtttctctgtgtgtctgtgtgtatgtcgatgtgcctgcatatgtctgtgtgtgtgtgtatctgtgtatgtctgtatttgtgtctctgtgtgtctgtgtgtctgtgtgtgtctcagtgtgtgtctgtgtctttgtgtgtctctgtgtatctgtgtgtgtgtctgtgtgtctccgtgtctctgtgtgtgtgtgtatggcctgtgtgtgtctgtgtgtgtgcacgtatgcgtccatgtgggtgtttgtgcgtgcatgtctgtgtctgtctctgtgtgtgt

SEQ ID NO: 69453 - DNA, 471 bp, Homo sapiens
aattcaagagtataatagagacgcatgttacaatgaacacctttgaacataaattttactcctatctctgattagatttctagttgtgcaattattagggcacatggcttacacatcttgagacttgttccatattgccaaaatgcttttctgatacttgcagtgtatcagatgcccattttgccatacccttgctagcctccagtattatttttagtaactctgccaatttctaggtgaaaaactgtacccccttgttttagagtgctttttaataggaaagtggaacattttctcataggtttagtggacaccactaataaataagcatttaacagattgtaaatcctttccatatatatatatatatgtatatacgtatttatttaacatttattgagtgcctattgtaagaacaggaagtatccctgctgccaaaatactcacagtcaagtgagtgagactgaccaa

SEQ ID NO: 69454 - DNA, 226 bp, Homo sapiens
cgctgttctagtttccagggttaggcctgaagataccagaaacttatattttccgtcttttgtatcattcactctagccagagacatttgcaaaacaatttaagaggggattccttcaatacttttctaatatccctctcccaaaggcctgtttattcttcagctaatttttactgataatttgtattttttagaaagaacgcatctctttattttatagtcatgt

SEQ ID NO: 69455 - DNA, 635 bp, Homo sapiens
gcggtgataaaggttgcccttgatagcatttctcataacagaatttataatatcatctcgtactcttgtcctagaggacttcccaaattctcgacatcaagtatacataaccatttaggttatgcataaaagaatcacacaaataatcaaccaatcttctatacctataggaaaaccttgatgcttattcaagtgctacaaaattcaattacaaaaggacatttctattatttttggcatatgtatttttaacaagaacaagaacaacaaggattttccggttttagtacccaattagccagacaatttaattaatctaattacattccatttcttagaacagtctggttaatttttactatataataatttattatgatatccttttcaaagaatgtacaggccaggtgcagtggctcgcacctgtaatcccagctttaatttgtcatatgtgaccctgctcacagcaaaacaaaatattaaagatgactggatagcaaataatttaactaaaaattaaattttcaattcagacgtttgattcttaactaattttgatttttaattacacagtctagatcctgttttggaagattttcctatgtttgggcaagtcacattttaagccagactac

SEQ ID NO: 69456 - DNA, 649 bp, Homo sapiens
gatgttgcattatatctataaagccaagcataaaataaatctttgcttatttctaggatttttgaacaaatatgatttatttaaaaataattgaaccagtttatgggaatgtcaacagaaaactactgtattaagtccaaattggacattagtaatttgcagtatagcaacatggctcagtctttgcagatcattttgttttccagagtcagtacccaccaatgttgctaccttccttcccaggctaggtactgctgtgacaataatgcaagtcggcagtgttgcctaaagatgtgcaaaatcaagaagatgaaattcattaaatttttttcctagttatttcttccctcaactcaattgttttttgacctggcctgatgttgtttagtgctctgcatggactactgtaattcagctcacagaagaacacacttgaaagaatagtactaaggatttgaaaaaaggatgacttctgacatcatcaaagtgttctccttttcatgattctttgggcagctggacagagcagtatgtccactagaatacttgagtctggttttgtgatttcacaagtaacacttgctcttcagtgacctgagtgagggtcacccatgcccagttatgttcagggcctggctgattatatgtt

SEQ ID NO: 69457 - DNA, 445 bp, Homo sapiens
cccacttcctctcccttttccccacctttatacaatcaccaccaataatggagcaaatgtggcacatccatccaaggatgggttgacatggtttacacattgctttcatttggttgttctttggatgaattcttccttgagaacaagataatgaaaaccatacggtcattgagcacacaatctgccttcactttggctgttccctcgcagcccgtttcattttataaagcctggtccctgagtttacgccagtagaagatcccaagcaggtggaatcctgccccctatgggcttgcagaattcagcaaacactgtcagtttagctcttgcctgtcacccatacatcagagaacttatttgaatggaacatctcttgctagtctggtaaaggtttagaaacttggccttctaagtattcatgtaagttctgttctgggaccttcat

SEQ ID NO: 69458 - DNA, 476 bp, Homo sapiens
aattgcatctctcatcctggggcaacgcatctataaacacagagacagtcatctgaggctctttttacgaggctgatggagtggagggaacccttcttcttggccacctctggctgtccctggaccgagacaaggcctcaggggagctctgagggccaggctgagagagacagtcccaggagcagagcccaccagacccatcacctcggccccagcccggcccccacaaccatgtggtcttagataatttggcttccctgagccccacttcctgcctgcaaggaggagatgatcacagaaccagctcccagggtgtgaggaggaccagatgcagacggagcctgcccactccctgtccagcagagcagaagggcagagggggtgctgcctccctcctgctgggagccccatgccaaggcccacctgcccgctctttactgcacgaaacatagccaagtctgttggtgctggtgcca

SEQ ID NO: 69459 - DNA, 150 bp, Homo sapiens
caaaatcttctaattccatagttttctaaagtagcatagaaaattaatgtcctttgctagccagtagtaaatcctcatctatttctgagactgggtaatatttttaaaaatgcatttaattttaatacatgctcgctgttttgaaaaatc

SEQ ID NO: 69460 - DNA, 324 bp, Homo sapiens
tgaaaggtttctaggatttattagtttgggttgttaagagttatacggctggcaacgctgtgcagggccgtttacttcagctgcatacattttttcgctgcatgaggggttggggagagctactctcttctggtcctgaaaagtaatcaagagagagagggatttttcacatcgtgtcttaattctcacaaaggcacgcttcaaatgacggataaaaacccgtcttcccgactccaagaagctactttctgacagttgtaaacaagcttctttctcttactgcacaggagagtcctcttacagatctcagatcctgacattatt

SEQ ID NO: 69461 - DNA, 361 bp, Homo sapiens
ggaacctatatacatgaaaagttagccctctttacacttgggttcacattctgcaaatactgtgttttcaatctgcatttggttggaaaaaatctttctgtaaatagacccatgcaattcaaacccatgttgcttaagggtcagttgtacattcacactgttgtgctaccatcctcatgatctgcttccaaaaccttttcatcacctcaaatagaaactctgtaatcattaaataataattggagtctgatttttagatactaaaagtaaactgagctctatcaggacagtaacgctattttacttatctccatctatagtatcttagtagcgccttgcagttactaggcaaacaagatat

SEQ ID NO: 69462 - DNA, 330 bp, Homo sapiens
gaagtgtctgtgaagtcaaacaaatgacctgtctacactgcttatgaaagtaacacattatctagtcataatgagcccatgaaaactgtgcctgtataaacaagcgagtctgcatgtattcataagaggcacttgggcgtgggaagagcagtccattggatctggtttgcaattctagctctaccagttactagttgtgtgaccttagacagctcacagttttctcagctatcacctgtggggtctcagttccccatctttgggaagattagctgtattaaacattatatcaagggtgacaccggtgactgctacattatgaagtcattt

SEQ ID NO: 69463 - DNA, 341 bp, Homo sapiens
tcttcctaataagagtaacaaagtatccgactcgatctggaaaacttgggagggaagtatcacgtattttactgttcttctacggtttggaattttctattgcacttacacactcaatatacagctgttccaatttgtttcgaagacaaaatgatcttacatctgttactgaggaagctgagagcactccttaaaaaccctagaaatatgagaattttgctgttgctgatgcctggtgtgggtcctaatgatatctctgtataacaaagcagttacgaagcctacagattttgtgcaaaataaaatacaaacaaggtgaatttttctcctcattcaaaaat

SEQ ID NO: 69464 - DNA, 356 bp, Homo sapiens
aaataaaataccttctcaaataaacccactgcttctttataccctgaaatgcatgttgagcaacatgagacacattctaactctatagaattattgcttctttgataattcaagaaaagacaaaggcactgatcaaacttgtttggtgccatttctatataatctaataaggttgttgttgttgttgttgttgttgttgttttgaaacggagtctcgctctgtcgcccaggctggagtgcagtggtgcgatctcggctcactgcaagctccgcctcccaggttcatgccagtctcccgcctcagcctcctgagtagctgggaatacaggcgcccaccaccacgcctggctaatttt

SEQ ID NO: 69465 - DNA, 326 bp, Homo sapiens
gtaaaaactgaatatctatatgcagaagaatggaactagactctcacctcttaccctttataaaaatctaattataatggtttaaagacctaaaactcagatatggaactagaagaaaacataagggaaaaacttccagacattggtcttagaaaacattttatgaataagacttcaaaaggagtcaagaaaagcaaaaataaataaataacatcatatcaaactaaaatgcttctgcacagcaaacaaaacaacagtgaaaagacaacctacagaatggtagaaaatatttgcaaaccattcatctgacaggggatttatatgca

SEQ ID NO: 69466 - DNA, 98 bp, Homo sapiens
gagctgttccaggcattgctatgtttaatttttgcacaaagtatcaagtaggttcctattatttagatgaaaaggaaaagattaaatatatcaagtat

SEQ ID NO: 69467 - DNA, 353 bp, Homo sapiens
agaccaagtttcagacaaaaatcttttccccagtatcctaaaatataaaaagcatgtgagtctctgtcttttgtatagccacgggggttgcagggcaggggagggtgcaggaaaaaaaaatagatgcaatgagaatataaatagtttttttgggatttacgcatttcaaacagggttaagttgtatatggctaccaaagcttgacggctttgtgagttaaaaacaaaaattatggcatattcttttatttcaagtgaaaagttttcatctaaaattcggtagcagttaggaaattatggctcatttttacctcctggaagcttggaatactgttttctctggaaaatgctttg

SEQ ID NO: 69468 - DNA, 333 bp, Homo sapiens
aagacagagagcagagactaccagagggtgagtggaggtacttgggtgggtctggctagtggggaaacaccctcattataccaggtgaaatataaagttaccattttgtagacaagaaggcatagaatattggcaatttcaaatgatcccatctaatatgttctatgtagcagtcttttgcatttgcccacctttcctccctctctccctcccttcctgctttcctttttcccttccttccattttttccttgctaggaatacaaagttgataaagattcaatgcccgcccttgagaaactcacagtatgcttggaaaaaacaaaatacaaac

SEQ ID NO: 69469 - DNA, 444 bp, Homo sapiens
cagccacaaaacctaaaataattcatccaaaaatccagactggaagatgaaatgacactcttcggaaagcaactgcttttattcaagagctctgacagttgagaaacaagatcaaatcaataagatacagaagtgtagtaatcatgcatgctgtttaaacacccagaagatagctcttgattttctgtgaaaattaaggagaggtgggccagtccacctgttagtaaaaaatgttatttaagtatttctgaagatcttttatcccaagtgcctctgcttctgcctcaactctgtgccttaaatgttcccaaaacggacagccaggcgcggtggctcacgcctgtaatcccagcactttgggaggccaaagcaggcagctcacgaggtcaggagttcaagaccagtctggccaacacagtgaaaccccgtcactactaaaaatac

SEQ ID NO: 69470 - DNA, 779 bp, Homo sapiens
cgtgaaccaacccactttgcactgtttgggagacagaaacctggctaaacatggcactgcaatgggcctgaacaaaaggcagaatctttaaaaattcctcttaaatgactctggagatacctggaaatgaaagtgccaagaaaggtgttccattttatttgctaactatttatgcattagctccccaagggtcattctcagattctcctggaattcttctccctcaggacccatggttcaaggaaggaagcttaggccctgttccttcctgtcctttgctggtctttcccttttttcctttctaggagggaagcttctgtgctgctgccctgagcccttccttcaggccagcacagtacctggggacctccacgggggaatgggatccaggccaggttgcttgctgagcctcatcacccaggaggcctgagcctctggggagggcacgcatgtacactgccagacccaggggagatcttgggaacagaggatgctacgtgatttcctctggcttccaacccaatcagcctgcatcacagtgaaacacaacacaaaaggccataaaaggcatacccctgagaaatgtttaagggcaggtgctagagtcagtgccagctccctgggaggagggatagggacgggcagatcagtagccagcttgtcctcaccctccggaagggagcaccggagaagacttgcacacgtccctgcctcccttgcggccttgtcaccagagggacacatctcctgggcacaatgtgcagggctgacctgggaga

SEQ ID NO: 69471 - DNA, 831 bp, Homo sapiens
gagcttgtgtaggcgctggggattcagagccgagtcggacacagcccctgtccttaaggagcccacgcttcgactgaaaccgcggcgtccctgcctttcttcgtttgcaccttatctcctctcttctctcaaggctggtgtccttgcagaaggcggcgacgctcagcccatcttacctcagggaccctctccgaggcttccacacttctgaaagcagctgttgaacacggaaaggcctggcgtggaatcctggctagcgctcaatcactgagccgcttcacccactttacattcacctctgaaagcatgatgcaggcgtccccaacttagggtggctcgacttaggggatttttcaactttgcgatgggcttatcgggaagcaacccatcataaatcgaggagcatctgtatagttatcttgcagagggcagtgaggtttaaaatgagctttggtgcttatcttgaggttgagtccgagtttcttccttacacgattattgtgaggatatgagatatttatgccaagcacattgcacattgcctgccagataagagtttcataaatgaggctgggattacagctgtgagccactgcacggcctccatgcggtcgtaacaccatgaggtagccacgttgggcagcttgtgcgttgtcagggagacactcttcctcagcccctgggcacctctgttgaaaacttcctggctgtctggcaggctggaaatcagctctatttgttttgccctgaagatatgttttatttataactcattctgactctgtagaaaataattcaataaaaactcaattggttttccactagccctga

SEQ ID NO: 69472 - DNA, 708 bp, Homo sapiens
ctacatcattagctagttaaggttttctgacctgacttctctttgtcttcctaggtatttatttgttatcttttaatcttgtgtatctaaattaacttagttaatagttacccaccgaataactatgccaagcaactagtaaagaatgtttattttatttccccttataggggaagagtggactgggaacaaaaatgtatgggccaaaaggccttagggttgtcattcattgactttcttattcctctcatgagctataattgagtatagtatttttttagtgctgatgtcattacttctcatgtcttcccctgagttgaaagcctacgacaaacatgtataaaatacatttaagaattttcagaatatgaaccacaaaactcagtatcttatatttaaatgctacttaagttattattggaatccaagtctcactaactagggtacatttttataaaatgtttctctgtatcttgaattgaaattacttgcccagaggcaagagttctggggatataacatgatttgagatcttttttaaaaaagggtggggcggcgggggagagagcgacaagtttatactagtttatgcttttgatattagtattttaagatacatcagttgatcccgaaacctgacattagaattactctgaggagcttttaaaatagattcctggagcctacccctggaaaattgtctcgctg

SEQ ID NO: 69473 - DNA, 346 bp, Homo sapiens
cggccaagtatttttattagttaaaaaattcagaataaaaatgtataaaaggaagatatgaaataagaatttattcaggaatcaaaaagacaaaatcatctcagatgagaacgatgattaaattactagaaaccaagggagaatagatttcacttaaaattataaacgtcaatgaggagaaaacaagcatagccaataaaaatagacttttgaaacacattaaaagctcagaaacgatagaagacaaataaatttcaatatatctgtaattggagtccttgagatacaaaccaaaaaaaagtaacagaatttatatttaaaactataattcaaaagaacattccag

SEQ ID NO: 69474 - DNA, 2229 bp, Homo sapiens
ctcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaaagtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaatccacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaagtttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcattggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtgggtgagaatctatgtacatataatatgtatgagaagactgttctcatagttagttgactcatatggtagagaggactttacatgaaatcagtatgaaaatagttttttagatacccagaagcttgttctgggagaagctagggcgggtcagagtagacctgatgggtaactcaggtaaagatgcttttcttttatctgaactacttaatgattgctttacttttactttttaaaaaattcagaaatccaataaaggaaaggacggtaacctt

SEQ ID NO: 69475 - DNA, 2269 bp, Homo sapiens
ctcaaaaaaggaaaatatataatgtatgccctcggaagggtaaaaagatttttattcatatgcatgagattattcagatagatggtcatatataccagtgccttgaatgcaagcaaaacttctgtgaaaacttagctcttattatgtgtgagagaacccatactggggagaaaccttataaaagtgatatgtgtgagaaaacctttgtccaaagctcagatcttacttcacaccagaggatccacaattacgagaaaccttataaatgtagcaaatgtgagaagagcttttggcatcacttagcgctttcaggacatcagagaacacatgcaggtaaaaaattctatacatgtgacatttgtggcaagaattttggtcagagttctgatctgcttgtccaccagcgaagccatactggcgagaaaccatatctatgtagtgagtgtgacaaatgcttcagtagaagtacaaacctcataaggcatcgaagaactcacacaggtgagaaaccatttaagtgtctcgagtgtgaaaaagcttttagtgggaaatcagatcttattagccaccagagaactcacactggggaaaggccctacaaatgtaataagtgtgagaaaagttaccgacaccgttcagccttcattgtacataaaagagttcatactggggagaagccctataagtgtggtgcctgtgaaaaatgctttggccagaaatcagaccttatcgtgcaccagagagtccacacaggtgagaagccgtataaatgcctggaatgtatgagaagttttactcggagtgccaacctaattaggcaccaggcaactcacactcacacttttaaatgccttgaatatgaaaaaagctttaactgtagctcagatcttattgtacatcagagaatccacatggaagagaaaccacatcagtggtctgcgtgtgagagtggcttcctcctaggaatggactttgttgcccaacagaaaatgagaactcaaacagaggagctacactataaatacactgtatgtgataaaagcttccaccagagttcagcccttcttcaacatcagacagtacacattggtgaaaaaccgtttgtctgtaatgtgagtgaaaaaggtcttgagcttagccctccccatgcgtcagaagcctcacagatgtcttgaccaggcgagaagctgtaataccaatattaaaaattatttatgtatcagagaactcattaagatgaggacaaatctcagactttgctcagagctcagaattcagtggggaccagagagcctgcaattggaaatatgagaaattctttgcccagagagctgccctaacagaacacttcatcctcactccaacgagaaatctacagatgcccagaggttttgaaaacttaccgtctgagctcaagtttgatcactcacaagaggattcatacaagtgggaaaccttagaaatgcactgagtgtgagagagctttctactaatgctcagcccttctcgttgtaagagaattcacaccggagaacaactttttaaatgccttcagtgtcagttgtgctgcagacagtatgaacatctcattggacctcagaaaacccaccctggggagaagccccagcaagtgtgaaaaaagcttctaacaaaactctgacttacccatcagagaagccatactggtgaaaaattgtatatttgtcttaagtatggcaaaagcattcattggagagccttacttgggtttgcacccaaaaaaaaaaacccaatctgaggaaagactgcaagtgtctgaatgaagagtgcttgtcaatgatcaactcttgtggtacatcagggaactcacataggtgaaaaaacccatacttaccttgagtctgagaaaacctttggtagaagctcctgtcttatcaggccccaaaaaacctgttctgcagtgagagatttaattgtggttctgccaaggaaagagaaaataccttttaatcccagggaaaggattgcaatcaccacattataagcataacctgaggttggagaggaccacttgggagcctgtaaccaaaactagaaggtaacttctgggatggacggaggttcccttgaagcagtgccaacctaaatctacctcaggtaagtagttagattaactttttcaagatttcagaccaaacaagacaacttgtattcagttgatgtattcctatgctttaatgtttttgtttgcccttaattattaaataaacatttgttctgaaaaactcca

SEQ ID NO: 69476 - DNA, 740 bp, Homo sapiens
agcaaatcaagacccataatgatacgtctttcatttatttcagttctgccaaggaaagagaaaataccttttaatcccagggaaaggattgcaatcaccacattataaggtatatggcgtggaatgcagaattctaaatactagaagggaaaagtagttggcagattcatcagaggcttaaggataagtacttgtttccaatttaaaagtataattaggattgtctttaatgttctctagaaatactataattaatctagagatctatcaatggtcacatctcagtttttttcttccctgagattcaaagacgtgtaataccaatacttcagattcctatagtatttgggactttgtagactagtgaatagatactttgttgctagtccaaatcctctgattttggtttgatttgtcctagcagatccctgaacttcagagagtattgccatttggattcatggagttggcgaactgctacactgctaccttgtgtatggctctaagctttgatcctaatgactggttgatgatcatgataatattagggccagtgaatatagctcatagtgataataaggattctagggtatttttttttcttttagaaaaagatcctggaagtttatttgatctgacatgtttttgtaatatttagaaatagctcttgtatcataaaaagttgcccagtataagacacacaagatgtatttttttctctggtgaaaatcatgcctatc

SEQ ID NO: 69477 - DNA, 1431 bp, Homo sapiens
tcttttatatatagttaattttttgccagttacaacgtccatagaaccccaagatttagaatgtatcatttatatttcctctaaaaggtagtaagatatttcttctgctgttttgtgaagccactcttctacagtatctgtagccttatagcaaattaattggttgtactaaaaattttagagactgcataggtctcccttttctatcctaattacctgcaatagcctagagacgctgagcatgattacattagcaacttgactgtttaaaaaatttgttatacttgataatgaccagactgtgtgctggagtcatttgtttccttcttttctgctccccgaatacactatttaatttggttacttttatttttaaactatatggcacccttttaaataaacattcattgctaattaaaatctgccaataaatggtctcagcatttaaataccatatattttataactcatactgtggctatcaaacagaagttaacacagtaggggtaaagatatacataatgtgtacctataggtgtatttataatgcctgtgtgcagtatacagacataattacaaaatactgcattttattaatgtttattttaatattgagaattggcattcttgtaaattgaactgacaattgcttctattcagtacactttattttgagcagatatttccgaaaagagaaaaaatcactgttgacatgctttttaaaactgttttcacctgtattttgtctttcaaaaagaaaagtgatctaagttggcattgtaaagaaattgttagcaaagaatatttttttttattttttcttttggtagaaagtcatgttaatagtacaacaaagaatcaaagaataaaacataatgtttaagaacattatttataagcagtcatggtctttgtgctttaaatgtttcccttttaccttagagttattttttaaaagttgaaagtactttaaaaatttgtttaaatgagtacccattgacaattatcatttaatagtgcagttaagttcaccgaaaaatttcaatatctcaaaaaaattagagaaaaatattggtaaatgtatttgattcacaaatgtattcatagccgattgtgagctgctctaccacattttcctgtttttattgtttctgtgaagcttgattagactaacttgcttaaggtctctttcccctcaaggattctgtgattctaatgtaacaaggtacacacgctctctctgaccacttaaagtatcagagttcaaatctgttacaatcactccatttccttttggaaagttgtgcctctcataaagctgcttggacattttaagtgttttgtaatatgcattgaagtgttgagttttgtttgctgtaagaggcatttcactatgttgattaaacttatcttttctcccaaaaaaaaaaa

SEQ ID NO: 69478 - DNA, 1402 bp, Homo sapiens
ccttagttacaaaaatactgcgttattgcagatctcaatactgtttaatagaatttggaaacattcctgtacgcgtgttcttgggagattattctgtacttcagttaggaatcctttaagtctgtaaacttcagtttcagcctaggtttttaagtagattaagcaaagttaatacttttcttttcttttcttttctttttgagacagagtctccctgtgtcgcccaggctggagtgcagtggcgcgatcttggctcagtgcaagctccgcctcccgggttcacgccattctcctgcctcagcctcccgagtagctgggactacaggcgcccgccaccacacctggctaattttgtttttgtatttttagtagagacagggtttcactgtgttagccaggatggtcttgatctcctgacctcgtgatctgcctgcctcagcctcccaaagtgctgggattacaggcgtgagccgccacacccagccattaatacgttttaaaaggccactatttttatcagctaaatcacttttgaaaattttgtgtgttatgtgttatactcaaaatattatcaaaacattctgttttcatttgaacctattgattagaatggtgcttatttatttggctgttgttcaagtacctgaattggcttggtcagaaggacttgggtgttctagctagctgtcgtataactaaatatttttggttaagtggtacatgtttagcattggcttgtcattttgaaatttttccatgcttcctgttaagaaatagaaccttaccaaattagtcatatttaaatataatctgtatagagttggtatggaaaacgatttgatctaaatacaaccaacaataaatatttttattgaaacttccttttaattgatgagtagtaatatggatgtcttcattagttgtaatgtcatttctattttactttcctaaatgtgaaagaaaagatgaaagaccatttcttggacatatcaaatgatttttaaggaatttctggtgattatttaaattttctagttaagctgtctaggtcagaattcatcattcaaaaatgctgctcaaacttgaagtgggtaggaatttctggggattttgattaagatgcagattctgactcattaaatctgagatgggcaagagtctgcatttctgacaagctcataggtgatgccagtgttcctgactacactttcagtagcagagttacagattatcccacattttgggggattttggagaatgatcttagtagaaaagataacaacagatgtttgcagtgatttgcctggatgtagttggtctgagatttaaaactatgataaatgttgccacaaatgtttaatagtgtttgggaccccaaggaaagattaggaacattgtctgc

SEQ ID NO: 69479 - DNA, 641 bp, Homo sapiens
cttttccagtcccacactggtcagttacagcctcctacgtcccagctgtgcgtttcctgtgaaaagaataagctcgcctaagaccatggcctgaggggactccagtgacgttcccagtgccagcagacagaactgcgcagaccccgcgggacgccatcctccatcaccatcatcgccggctgccctccacccccagcccactccacggccagaggtgcatctccggcctccagacacgcacaacaggtttcaggggtccctcaaacatctgggctgtcatccttcggagagactggaactgagacacaaggagagacctagtgatgtgggagagttaggagaagaagcagtgatttcaaacgcatgcccctcacacggaagaagggcagggggaaagccatgcaggtgtgggcgtggcacttgagcagcctctcccatgggcacccagtggttaatgcacaatgtttagcacgtcgcccagggaggccatccccttccgctacccctttcatggcaaatgctgaaacatcgttgaagactcctctcaagggtctcctcttccaggaagccttcggtcaggaataggtgccccttctggctcctcctagcctgaaagccaacatgaaatctccctgggctga

SEQ ID NO: 69480 - DNA, 501 bp, Homo sapiens
acttctccaccattcttcaaagcaaaccccttctcctggaagttctccctgattccattcagcctaactgaccactctctcctctgtacttctgacctccctctgcccaagtgatcagcagcacaagttctataagggcagaaccatgtctgtctccagagcctggcacaaggcctgacacctaaagagcacccaaagaacatctgtgccatcaatgaatgaatgaatgaatgaagcaatggttccatcttgctcttgtctgggctccagagcctggtattcagaaaatgtcatttcagcagagaactaactggatgtggctgcggcagccctgaagagcccatagaagaaaagtttgaattccccagaatcagcccattcttgcattaatttcaaaacatagttgagtgcctactgtgtgtgccaggcactggtggtggtgatacagcagtaagcaagagagacagtaaaaaatacagacaagcaaacaggcctggcagc

SEQ ID NO: 69481 - DNA, 461 bp, Homo sapiens
cttttccagtcccacactggtcagttacagcctcctacgtcccagctgtgcgtttcctgtgaaaagaataatgatcagcagcacaagttctataagggcagaaccatgtctgtctccagagcctggcacaaggcctgacacctaaagagcacccaaagaacatctgtgccatcaatgaatgaatgaatgaatgaagcaatggttccatcttgctcttgtctgggctccagagcctggtattcagaaaatgtcatttcagcagagaactaactggatgtggctgcggcagccctgaagagcccatagaagaaaagtttgaattccccagaatcagcccattcttgcattaatttcaaaacatagttgagtgcctactgtgtgtgccaggcactggtggtggtgatacagcagtaagcaagagagacagtaaaaaatacagacaagcaaacaggcctggcagc

SEQ ID NO: 69482 - DNA, 316 bp, Homo sapiens
tctgaaggaagagtgaatgggatcctttatggattggatggaaggaggtgataaaagaagagggggtgcagaggatgcctacaatgttttgtagacagtgaccctgagatctagagaagatgtagtgtgaggccacacagctagtcagtgggtgggggtggaggagaggaggatgggaccagggtggcgggaaggtcctcaggtctaggacagcatctgggagaggatagggggaaggactctggcatagctggtcacaaaccagccccagggcaactgagcattgatttgatcaatggctttttcctcttccctt

SEQ ID NO: 69483 - DNA, 206 bp, Homo sapiens
ctagccacaaaaacactcaattatgaatgaattgcaaaataaaaatttaaatatacatcctcatttaaaaaacaaaatctctgtggccttaagagaaatatttcttaaataaaaaatatttaatatactgggaaaaataacaaataaaattttattaaaattaagagcttattaaaatacagaaagagagagactgagtgagagag

SEQ ID NO: 69484 - DNA, 585 bp, Homo sapiens
caattgaagaagaaaactctacaataatagtgaaattagtggaaagtccttattttgaatattaaaggattgattaaaagattgatttgagcatcacatgattgagaggcccttgaggaaactgatgatacccttgatttttttctgtaagaattaccttctctgattctgctacaaaaagaccaacatgaagtgatgaatgttagatggtgctgtaatataattttgttagaacaattacaaatacaattaatatttggttcattctttgctgtttttgagaattagtacatggttgcagttttaacctacatattgttaacattgttaaatatttcatcaatttatttttgtagtttgtagttttgtttcaaggtgaagtatttggtttttgttgttgtttttttgacacaagagtctccctctgttgctgaggctggagtgtagtgctgcagtctctgctcactgcaacctccgcctcccgggtacaggagaactgcttgaacccgggaggtggaggttgcagtgagccgagatcgtgccattgcattccagcttgggcaatagaatgagactccatctcgg

SEQ ID NO: 69485 - DNA, 398 bp, Homo sapiens
aattacctccaaacaattacatttgtattgcactcatatcctgtaatccaaatcccattcttccaaattgcctgcaatatgaaacatgactaactccttccttgcaagaatattttttctgacacgtgtggtgacatcttttaaatagattcttacaaactgaacttgctacacagtatgtaagtactacttggaatgtgtgaagaaatcttcactgcataaacccaagagttcaccaagaacataagctcccgccctacccccacctctctcctctttgggacatattgaagttcctgggaaaagtggggcacccccagagcacctgtgtacccctgtacccacctgtcctgagtggtccaaatgccagtgaaatgctatttggtgagtgtttccta

SEQ ID NO: 69486 - DNA, 462 bp, Homo sapiens
gtttcaaacaccccagtgttggaacctgaagatagaattcctgtggtttagacacaaatgcctgctactaggatttacagatggggctctcctttaagtcttaggagacatggctcagaaatgatcatgcaatctctcaacaatttctcaggaatgaccaacagtctctcagaatacagcaaaacatctgtttcttacatgtaactccaccgaacacaggctgccttccccatacacatgtttttctggcggggattgtatgacatgtgaattcaaaggaccatttcttttgccccatgacaagcctttcagagggtgaagtgcttggatttagagtgattctccttagaggatttacccccagttgttgaaatatggcaaataccaagtgtccacgatttattataagacaataaagtgattgttccttatggagtactccctacactctggagaaaagca

SEQ ID NO: 69487 - DNA, 484 bp, Homo sapiens
tgaaaaagtacaaaattttgttgcaaaacattcagaccagcaaaagtaaacacacaggggaaaggaacaatcaccagaacttgtaatattgttgtgaggagttgtttagcagtggctgaaggctgggttcctgccagagctactgatctacactcaaacgcccttagataaataattacactcttaagctgtgtcgagtgctgatacacttgaccttgtaaatagaaatgtttgcagtaggaataaactccggcattggaaaatcttttaaacattaacacaaaagagagcgctctgtcctctagggatttgagcctgaacctcgccaagctaggcacttgcaagggggaaaaaaagtttatttatcttctattcctggtgtttgtttaaagcttttcattttaaacgcggtgattggaaggcaagtcgggagtttaaaagtcaccacaaataaactttgtctgaggggtcgacagattagcaa

SEQ ID NO: 69488 - DNA, 520 bp, Homo sapiens
caactggctcacttaaccatgaatgtgaaaggttgaaaagcttatttaaatgtgggctactgaactttcctggggctacaagaactgatactttgttcagccattacactcagtgaaactctctttttaaatgaacctcgtttcacattatacaaactggaccagactggctggaaagggcaggaggctccctgtgcaggcccacggtggaagggggccagcgtgattgcagacagggtccccctctgctggaaagcttccaattctctaactaccagcatcttccattttccctattagctttctcctgtgataatttttctacttttaccttgtaaaccaaaaataagattcacagccccctgaccatctgaacggacccctcctcttggcaagggcattccaaagctaacctgaaaaactagctcaggccatgatgggaaagaggagctggacatgcctcgttatgccctattcccttttggaattactgatagaacagactatttaagtctcataa

SEQ ID NO: 69489 - DNA, 353 bp, Homo sapiens
gcgcaccagtcagcagccaggtggcaaacatcaattttaggtagggacgttgcaagtgccccaagtcacatgtcaacatagagaataggggaggtaggagtgggggtggcagctgcagagaacaaaagaggaaacgaataagataggtccgacctaagaaaaaggaggtgtctatgggctgacctgatggagtgaaccagaaattcagacggcagcacagctagatactttagaactaccggcatcctaaaatctggctcccaagcctctgtcataaagtaggtctgtgtcctcggtatagtcacttaaccacactttgcatcactctcctcatttgtaaaatcagagaggct

SEQ ID NO: 69490 - DNA, 449 bp, Homo sapiens
ttctctgtgccatgtgagaacacagctacaacatggcgatcagcaagacaggaagacagccctcaccaggagctgaatcactggcgctttgatcttgcacttccagatcctgggcaagactcaccagggcagacttctgtagctgcctggaattgtctgatctggaattaatgccctggaatgctgtggttgttaactcagaaggcacaaagctaagaatcttcctctggtcctctttaatctgcccccactccttgttatttgtcttattttgattttcaagtaaggaatttattttcccagttaacataaccaaccagcccatgccacagtatattaaaccaagaagtacaaatccaagaaaggtaacgtctttattgggttgcaaaactttgggaaatcaatgtagtactttttattacaataaaagcatatttttattagagaca

SEQ ID NO: 69491 - DNA, 297 bp, Homo sapiens
ggggggggggtctaaattattattaatagcgtattttaatctatttaattttaagatggctataatgtaattaaagcactactttaaatatacgccgagtactaggcaatgagtaaacattataaaagtataaaagtcggccgggcgcggtggctcacgcctgtaatcccagcactttgggacgccgaggcaggcggttcacaaggtcagcagatcgagaccatcctggctaacacggtgaaaccccgtctctactaaaaatacaaaaaattagccaggcgtggtggcgggcgcctg

SEQ ID NO: 69492 - DNA, 362 bp, Homo sapiens
gaattgcaaattagctcaaaccagatcatgcagaaaatctggatatatggaatgaaaagtattgcacaaatgtgttgcataagtaatttattgtcttctggctgctaatttataggtgtaacctcacatactatcttttgatcgccattaagggactgttttgcaccaatagactgagagcaaacattttaatacaacatattcagtctaattaagctggataattactgctggagaagagctatggtagcaacagcatgtaaataaatttttgcaagtatagaagggaaacctaacatttcatattcatgtagattacctcttttcaaatacaagaagacaaatgttattctagcccgttt

SEQ ID NO: 69493 - DNA, 881 bp, Homo sapiens
  misc_feature (843)..(843): n is a, c, g, or t
gactcgactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaatccctgaattttatacatcttcagttttctctgaattgattctaccacacaacaaggtctgtgtctagatgagaagataaatttggcattctcaatccagccatttttttttccggtcccacttttacatatctacacttggcgccaaaaaaaaaaaagtggggccccgaataaangggccgaaatatcacaaaaggtcaacccggggtaccag

SEQ ID NO: 69494 - DNA, 869 bp, Homo sapiens
gactcgactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69495 - DNA, 773 bp, Homo sapiens
gactcgactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctc

SEQ ID NO: 69496 - DNA, 880 bp, Homo sapiens
gactcgactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaattttatacatcttcagtttctctgattgattctaccacacaacaaggtctgtggcctgatgagagaataatattgcttcgaaaaaaaaaaaaaaaaaaatgtgggggcgcggccgaaaatttaacacgtggggggccggtggaaaggagtcagaacgggggaggggttccaaacggggggggaaaagggtggtgtacgggccgg

SEQ ID NO: 69497 - DNA, 967 bp, Homo sapiens
tcaaagccagtgtccttgaagatggacccttttaaaaaaaaaaatggcaccaaagaaagacgtgaagaaacctgtggctgcggctgcggctgccccagccccggcaccggcacctgcacctgcccctgccccagccaaacccaaagaagaaaaaattgacctctctgccattaagatcgagttctctaaggaacagcaggatgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69498 - DNA, 398 bp, Homo sapiens
tggggccgtccctgttatacttaggatccccttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69499 - DNA, 395 bp, Homo sapiens
ggggatcgattggtaacttaggatccccttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69500 - DNA, 801 bp, Homo sapiens
gactcgactcagggaccggagcagccctcaactcactcttcagcttccctgctgtgttgcagcccagccgctccatcatgtccttcagtgctgaccagattgctgatcgagttctctaaggaacagcaggatgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaacaccctgaatttttatacatcttcagtttttctctgaattgaattcataccacacaaacaaagtgtctgctgctctagatgagaagaataaaatattgacaatctc

SEQ ID NO: 69501 - DNA, 675 bp, Homo sapiens
gactcgactcagggaccggagcagccctcaactcactcttcagcttccctgctgtgttgcagcccagccgctccatcatggtgggtcctatgagacaataatttagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaatccctgaattttatacatcttcagttttctctgaattgattctaccacacaacaaggtctgtgtctagatgagaagataaatttggcattctcaatccagccatttttatattacatgatcaaaaatttaaacataattataacattggtcgc

SEQ ID NO: 69502 - DNA, 762 bp, Homo sapiens
gactcgactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagctgatcctgatggtttcgagttcttagagactctcaaggctgtggcccagatagcactgaaaacccagatcttagcatcatctggattgaccctgatgacttccccctgcgtggtcccatactgggagaagacgtgtgacatcgacttgtctggcccacaaataggagtcgtcatgtgactggtgcggatgcgtctggtggccactggccgtgggaggactgcttctgctgggagctgaggctggctgaggtgtctggaggcggtcaccgaggcgggcgggtttgtgctgtgtgggcctttcgccgggttggcgccgg

SEQ ID NO: 69503 - DNA, 562 bp, Homo sapiens
ggggatcgattggtaacttaggatccccttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaactgcataattggcccccctcggcctaatcgctcgcactccggcggccgctcccctcacaagaggcttcaccctgaacaccgcttactgcacctccccaattcgtcaatctgcttccttaacccccctaagcccactaacaggccgcaatcatgttctccccccaccc

SEQ ID NO: 69504 - DNA, 299 bp, Homo sapiens
ggggatcgattggtaacttaggatccccttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctc

SEQ ID NO: 69505 - DNA, 559 bp, Homo sapiens
gactcgactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctc

SEQ ID NO: 69506 - DNA, 394 bp, Homo sapiens
gtcttttagttactcttcgcatcctccttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69507 - DNA, 434 bp, Homo sapiens
  misc_feature (1)..(1): n is a, c, g, or t
  misc_feature (11)..(13): n is a, c, g, or t
  misc_feature (41)..(41): n is a, c, g, or t
  misc_feature (51)..(51): n is a, c, g, or t
ncgaagagtcnnncccacacgggaaaacgggcgccgcagcnacctacaggnagcaaagggacccatttctttgtcaagcacatcatgtctatctgaatggagctctcagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69508 - DNA, 393 bp, Homo sapiens
  misc_feature (1)..(1): n is a, c, g, or t
  misc_feature (15)..(16): n is a, c, g, or t
ntcgttaggtcttcnncggcaccttggctttgtcaagcacatcatgtctatctgaatggagctctcagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctccgctccgttttcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69509 - DNA, 1033 bp, Homo sapiens
gactcgactcagggaccggagcagccctcaactcactcttcagcttccctgctgtgttgcagcccagccgctccatcatgctttttatgttcctagattcaaaagtatcctaaggcaaccttctaatgccaagacacctacatagcttcctaaaaatctcagagcaaccagcactcattcttctgtcaatgcatttgaaagagtactagttttttttctttctttctcttcttcgccactgcagtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69510 - DNA, 1616 bp, Homo sapiens
gactcgactcagggaccggagcagccctcaactcactcttcagcttccctgctgtgttgcagcccagccgctccatcatggtgggtcctatgagacaataatttgtcatttataggagaaaatagatagaggatatgatcttatgagaagaaagataggcaaaaatggaactgaggagagaacatattcaatatgagtctttagtatctacttttgggttttgtgagatccattaaagataggagaaaataattagagctgtttatcagctggaaaaatacatcttccaagagctgtgctttatgcttcaccaactcttgctgtatcacataagattcattatatctaaatttagaagaaaaaaacctgtagctacagcaaaatattatacattaaaatacaatccagtgatgctgatagctaaaactaagtaaactgcttttgatgcattgggtttggtgtactatttttttaagcactggttaaatagaagacagacttaaggtagtctttttaatgtgtatatctgtactttaacaccgtgtatcttattagacatatcttaaatatactatagattatttttctaggaagtattaaatgtagcatttagttaaatcattaagatgcagaaagatattccctaattatcttttgcaatagctttttatgttcctagattcaaaagtatcctaaggcaaccttctaatgccaagacacctacatagcttcctaaaaatctcagagcaaccagcactcattcttctgtcaatgcatttgaaagagtactagttttttttctttctttctcttcttcgccactgcagtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69511 - DNA, 607 bp, Homo sapiens
gtgtctagacggatccctggcaggtgctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69512 - DNA, 958 bp, Homo sapiens
gactctgggtccatcttcaagacactgggctgtggatcaacccaaccaccactcctcttccaagaatcattttgacaggttcttttggaggaactccttctctttttaacccacccttttaaaaaaaaaaatggcaccaaagaaagacgtgaagaaacctgtggctgcggctgcggctgccccagccccggcaccggcacctgcacctgcccctgccccagccaaacccaaagaagaaaaaattgacctctctgccattaagatcgagttctctaaggaacagcaggatgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctc

SEQ ID NO: 69513 - DNA, 891 bp, Homo sapiens
gactcgactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaatgcacaccgggatcctctagac

SEQ ID NO: 69514 - DNA, 805 bp, Homo sapiens
gactcgactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaacaccctgaatttttatacatcttcagtttttctctgaattgaattcataccacacaaacaaagtgtctgctgctctagatgagaagaataaaatattgacaatctcgacacaagtgaagagggggatcctctagggcg

SEQ ID NO: 69515 - DNA, 399 bp, Homo sapiens
gtgtaggttgaatgtcgcatcaaggagcagacttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69516 - DNA, 1059 bp, Homo sapiens
gactcgactcagggaccggagcagccctcaactcactcttcagcttccctgctgtgttgcagcccagccgctccatcatgctttttatgttcctagattcaaaagtatcctaaggcaaccttctaatgccaagacacctacatagcttcctaaaaatctcagagcaaccagcactcattcttctgtcaatgcatttgaaagagtactagttttttttctttctttctcttcttcgccactgcagtccttcagtgctgaccagattgctgatcgagttctctaaggaacagcaggatgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatggcacagtcatgggtgctgaactccgccatgttctagccaccctgggtgaaaagatgaaagaggaagaagtggaagccctgatggcaggtcaagaagactccaatggctgcatcaactacgaagctttgtcaagcacatcatgtctatctgaatggagctctcagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa

SEQ ID NO: 69517 - DNA, 554 bp, Homo sapiens
gactcgactcagggaccggagcagccctcaactcactcttcagcttccctgctgtgttgcagcccagccgctccatcatgtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagagctgaatgccaagaaaattgagtttgaacaatttctgcctatgatgcaagccatttccaacaacaaggaccaggccacctatgaagactttgttgagggtctgcgtgtctttgacaaggaaggcaatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctc

SEQ ID NO: 69518 - DNA, 1402 bp, Homo sapiens
gactcgactcagggaccggagcagccctcaactcactcttcagcttccctgctgtgttgcagcccagccgctccatcatggtgggtcctatgagacaataatttgtcatttataggagaaaatagatagaggatatgatcttatgagaagaaagataggcaaaaatggaactgaggagagaacatattcaatatgagtctttagtatctacttttgggttttgtgagatccattaaagataggagaaaataattagagctgtttatcagctggaaaaatacatcttccaagagctgtgctttatgcttcaccaactcttgctgtatcacataagattcattatatctaaatttagaagaaaaaaacctgtagctacagcaaaatattatacattaaaatacaatccagtgatgctgatagctaaaactaagtaaactgcttttgatgcattgggtttggtgtactatttttttaagcactggttaaatagaagacagacttaaggtagtctttttaatgtgtatatctgtactttaacaccgtgtatcttattagacatatcttaaatatactatagattatttttctaggaagtattaaatgtagcatttagttaaatcattaagatgcagaaagatattccctaattatcttttgcaatagctttttatgttcctagattcaaaagtatcctaaggcaaccttctaatgccaagacacctacatagcttcctaaaaatctcagagcaaccagcactcattcttctgtcaatgcatttgaaagagtactagttttttttctttctttctcttcttcgccactgcagtccttcagtgctgaccagattgctgaattcaaggaggcatttctcctgtttgacagaacaggtgattccaagatcaccttaagccaggtcggtgatgtccttcgagctctgggcacaaatcccaccaatgcagaggtcaggaaagttctgggaaaccccagcaatgaagaggtcaagaagactccaatggctgcatcaactacgaagcttttgtcaagcacatcatgtctatctgaatggagctctcaagaacaagcattgtttaggaagactggctggaaacttattttaatcacacccatgacaaactctccagatctgtttaccatcattcaggaaaacaaagcaatctggacggttcaagactgagcaactccctgaatttttatacatcttcagtttttctctgaattgaattcataccacacaaacaaagtgtctgctgctctagatgagaagaataaaatattgacaatctcaaatccaagcaccattctttattatctaccatgaatcaacaaacattcttaaaacaataaatcaataaacaattttggtcagtctggaaaaaaaaa
